US012215359B2

(12) United States Patent
Yi et al.

(10) Patent No.: US 12,215,359 B2
(45) Date of Patent: Feb. 4, 2025

(54) ENGINEERED GLUCOSE DEHYDROGENASES AND METHODS FOR THE REDUCTIVE AMINATION OF KETONE AND AMINE COMPOUNDS

(71) Applicant: Codexis, Inc., Redwood City, CA (US)

(72) Inventors: Xiang Yi, San Carlos, CA (US); Oscar Alvizo, Fremont, CA (US); Ravi David Garcia, Los Gatos, CA (US); David Entwistle, San Carlos, CA (US); Charlene Ching, San Jose, CA (US); James Nicholas Riggins, San Francisco, CA (US); Nandhitha Subramanian, Cambridge (GB)

(73) Assignee: Codexis, Inc., Redwood City, CA (US)

(*) Notice: Subject to any disclaimer, the term of this patent is extended or adjusted under 35 U.S.C. 154(b) by 518 days.

(21) Appl. No.: 17/600,357

(22) PCT Filed: Apr. 23, 2020

(86) PCT No.: PCT/US2020/029517
§ 371 (c)(1),
(2) Date: Sep. 30, 2021

(87) PCT Pub. No.: WO2020/223104
PCT Pub. Date: Nov. 5, 2020

(65) Prior Publication Data
US 2022/0145268 A1    May 12, 2022

Related U.S. Application Data

(60) Provisional application No. 62/841,666, filed on May 1, 2019.

(51) Int. Cl.
*C12N 9/04* (2006.01)
*C12N 1/20* (2006.01)
*C12N 15/72* (2006.01)

(52) U.S. Cl.
CPC ............. *C12N 9/0006* (2013.01); *C12N 1/20* (2013.01); *C12N 15/72* (2013.01)

(58) Field of Classification Search
CPC ......... C12N 9/0006; C12N 1/20; C12N 15/72
See application file for complete search history.

(56) References Cited

U.S. PATENT DOCUMENTS

| | | |
|---|---|---|
| 5,605,793 A | 2/1997 | Stemmer |
| 5,811,238 A | 9/1998 | Stemmer et al. |
| 5,830,721 A | 11/1998 | Stemmer et al. |
| 5,834,252 A | 11/1998 | Stemmer et al. |
| 5,837,458 A | 11/1998 | Minshull et al. |
| 5,928,905 A | 7/1999 | Stemmer et al. |
| 6,096,548 A | 8/2000 | Stemmer |
| 6,117,679 A | 9/2000 | Stemmer |
| 6,132,970 A | 10/2000 | Stemmer |
| 6,165,793 A | 12/2000 | Stemmer |
| 6,180,406 B1 | 1/2001 | Stemmer |
| 6,251,674 B1 | 6/2001 | Tobin et al. |
| 6,265,201 B1 | 7/2001 | Wackett et al. |
| 6,277,638 B1 | 8/2001 | Stemmer |
| 6,287,861 B1 | 9/2001 | Stemmer et al. |
| 6,287,862 B1 | 9/2001 | delCardayre et al. |
| 6,291,242 B1 | 9/2001 | Stemmer |
| 6,297,053 B1 | 10/2001 | Stemmer |
| 6,303,344 B1 | 10/2001 | Patten et al. |
| 6,309,883 B1 | 10/2001 | Minshull et al. |
| 6,319,713 B1 | 11/2001 | Patten et al. |
| 6,319,714 B1 | 11/2001 | Crameri et al. |
| 6,323,030 B1 | 11/2001 | Stemmer |
| 6,326,204 B1 | 12/2001 | delCardayre et al. |
| 6,335,160 B1 | 1/2002 | Patten et al. |
| 6,335,198 B1 | 1/2002 | delCardayre et al. |
| 6,337,186 B1 | 1/2002 | Krebber |
| 6,344,356 B1 | 2/2002 | Stemmer |
| 6,352,859 B1 | 3/2002 | delCardayre et al. |
| 6,355,484 B1 | 3/2002 | Patten et al. |
| 6,358,740 B1 | 3/2002 | Patten et al. |
| 6,358,742 B1 | 3/2002 | Stemmer |
| 6,365,377 B1 | 4/2002 | Patten et al. |
| 6,365,408 B1 | 4/2002 | Stemmer |
| 6,368,861 B1 | 4/2002 | Crameri et al. |
| 6,372,497 B1 | 4/2002 | Stemmer |
| 6,376,246 B1 | 4/2002 | Crameri et al. |

(Continued)

FOREIGN PATENT DOCUMENTS

| | | |
|---|---|---|
| CN | 108588045 A | 9/2018 |
| EP | 0641862 B2 | 12/2001 |

(Continued)

OTHER PUBLICATIONS

Liang et al (Bioresource Technology, vol. 147, Nov. 2013, pp. 492-498) (Year: 2013).*
Roth et al (Chem BioChem 2020, 21, 2615-2619) (Year: 2020).*
Nisthal et al (Proc Natl Acad Sci U S A. Aug. 13, 2019;116(33):16367-16377) (Year: 2019).*
Singh et al (Curr. Protein Pept. Sci, 18:1-11; 2017) (Year: 2017).*
Makino et al (vol. 264, No. 11, Issue of Apr. 15, pp. 6381-6385, 1989) (Year: 1989).*
Stellwagon, E., "Dye Affinity Chromatography," Current Protocols in Protein Science, Unit 9.2-9.2.16 [2001].
Stemmer, W., "DNA Shuffling by Random Fragmentation and Reassembly: In vitro Recombination for Molecular Evolution," Proc. Natl. Acad. Sci. USA, 91:10747-10751 (1994).
Stemmer, W.P.C., "Rapid evolution of a protein in vitro by DNA shuffling", Nature, 370:389-391 (1994).

(Continued)

*Primary Examiner* — Thomas J. Visone
*Assistant Examiner* — Georgiana C Reglas
(74) *Attorney, Agent, or Firm* — Codexis, Inc.

(57) ABSTRACT

The present application provides engineered glucose dehydrogenase polypeptides having imine reductase activity, polynucleotides encoding the engineered polypeptides, host cells capable of expressing the engineered polypeptides, and methods of using these engineered polypeptides with a range of ketone and amine substrate compounds to prepare secondary and tertiary amine product compounds.

21 Claims, No Drawings

Specification includes a Sequence Listing.

(56) References Cited

U.S. PATENT DOCUMENTS

| | | |
|---|---|---|
| 6,379,964 B1 | 4/2002 | delCardayre et al. |
| 6,387,702 B1 | 5/2002 | Stemmer |
| 6,391,552 B2 | 5/2002 | Stemmer |
| 6,391,640 B1 | 5/2002 | Minshull et al. |
| 6,395,547 B1 | 5/2002 | Stemmer |
| 6,406,855 B1 | 6/2002 | Patten et al. |
| 6,406,910 B1 | 6/2002 | Patten et al. |
| 6,413,745 B1 | 7/2002 | Patten et al. |
| 6,413,774 B1 | 7/2002 | Stemmer |
| 6,420,175 B1 | 7/2002 | Stemmer |
| 6,423,542 B1 | 7/2002 | Crameri et al. |
| 6,426,224 B1 | 7/2002 | Crameri et al. |
| 6,436,675 B1 | 8/2002 | Welch et al. |
| 6,444,468 B1 | 9/2002 | Stemmer et al. |
| 6,455,253 B1 | 9/2002 | Patten et al. |
| 6,479,652 B1 | 11/2002 | Crameri et al. |
| 6,482,647 B1 | 11/2002 | Stemmer |
| 6,483,011 B1 | 11/2002 | Stemmer et al. |
| 6,484,105 B2 | 11/2002 | Zhang |
| 6,489,146 B2 | 12/2002 | Stemmer et al. |
| 6,500,617 B1 | 12/2002 | Stemmer et al. |
| 6,500,639 B2 | 12/2002 | Subramanian |
| 6,506,602 B1 | 1/2003 | Stemmer |
| 6,506,603 B1 | 1/2003 | Stemmer |
| 6,518,065 B1 | 2/2003 | Stemmer |
| 6,519,065 B1 | 2/2003 | Colbourne et al. |
| 6,521,453 B1 | 2/2003 | Crameri et al. |
| 6,528,311 B1 | 3/2003 | delCardayre et al. |
| 6,537,746 B2 | 3/2003 | Arnold et al. |
| 6,573,098 B1 | 6/2003 | Stemmer |
| 6,576,467 B1 | 6/2003 | Stemmer |
| 6,579,678 B1 | 6/2003 | Patten et al. |
| 6,586,182 B1 | 7/2003 | Patten et al. |
| 6,605,430 B1 | 7/2003 | Affholter et al. |
| 6,602,986 B1 | 8/2003 | Stemmer et al. |
| 6,613,514 B2 | 9/2003 | Patten et al. |
| 6,653,072 B1 | 11/2003 | Patten et al. |
| 6,686,515 B1 | 2/2004 | Lassner et al. |
| 6,703,240 B1 | 3/2004 | Stemmer et al. |
| 6,716,631 B1 | 4/2004 | delCardayre et al. |
| 6,825,001 B2 | 11/2004 | Wackett et al. |
| 6,902,922 B2 | 6/2005 | Ness et al. |
| 6,917,882 B2 | 7/2005 | Selifonov et al. |
| 6,946,296 B2 | 9/2005 | Patten et al. |
| 6,961,664 B1 | 11/2005 | Selifonov et al. |
| 6,995,017 B1 | 2/2006 | Stemmer |
| 7,024,312 B1 | 4/2006 | Selifonov et al. |
| 7,058,515 B1 | 6/2006 | Selifonov et al. |
| 7,105,297 B2 | 9/2006 | Minshull et al. |
| 7,148,054 B2 | 12/2006 | delCardayre et al. |
| 7,220,566 B2 | 5/2007 | Ness et al. |
| 7,288,375 B2 | 10/2007 | Stemmer et al. |
| 7,384,387 B1 | 6/2008 | Raillard et al. |
| 7,421,347 B2 | 9/2008 | Selifonov et al. |
| 7,430,477 B2 | 9/2008 | Selifonov et al. |
| 7,462,469 B2 | 12/2008 | Bass et al. |
| 7,534,564 B2 | 5/2009 | Patten et al. |
| 7,620,500 B2 | 11/2009 | Mundorff et al. |
| 7,620,502 B2 | 11/2009 | Selifonov et al. |
| 7,629,170 B2 | 12/2009 | delCardayre et al. |
| 7,702,464 B1 | 4/2010 | Emig et al. |
| 7,747,391 B2 | 6/2010 | Gustafsson et al. |
| 7,747,393 B2 | 6/2010 | Fox |
| 7,751,986 B2 | 7/2010 | Gustafsson et al. |
| 7,776,598 B2 | 8/2010 | Patten et al. |
| 7,783,428 B2 | 8/2010 | Gustafsson et al. |
| 7,795,030 B2 | 9/2010 | Minshull et al. |
| 7,816,111 B2 | 10/2010 | Davis et al. |
| 7,853,410 B2 | 12/2010 | Selifonov et al. |
| 7,868,138 B2 | 1/2011 | Stemmer et al. |
| 7,873,477 B1 | 1/2011 | Gustafsson et al. |
| 7,873,499 B2 | 1/2011 | Selifonov et al. |
| 7,904,249 B2 | 3/2011 | Selifonov et al. |
| 7,939,309 B2 | 5/2011 | Davis et al. |
| 7,957,912 B2 | 6/2011 | Selifonov et al. |
| 7,981,614 B2 | 7/2011 | Stemmer et al. |
| 8,014,961 B2 | 9/2011 | Bass et al. |
| 8,029,988 B2 | 10/2011 | Crameri et al. |
| 8,048,674 B2 | 11/2011 | Minshull et al. |
| 8,058,001 B2 | 11/2011 | Crameri et al. |
| 8,076,138 B2 | 12/2011 | delCardayre et al. |
| 8,108,150 B2 | 1/2012 | Mundorff et al. |
| 8,170,806 B2 | 5/2012 | Selifonov et al. |
| 8,224,580 B2 | 7/2012 | Mundorff et al. |
| 8,377,681 B2 | 2/2013 | delCardayre et al. |
| 8,383,346 B2 | 2/2013 | Colbeck et al. |
| 8,457,903 B1 | 6/2013 | Emig et al. |
| 8,504,498 B2 | 8/2013 | Fox |
| 8,589,085 B2 | 11/2013 | Selifonov et al. |
| 8,762,066 B2 | 6/2014 | Fox |
| 8,768,871 B2 | 7/2014 | Fox |
| 9,593,326 B2 | 3/2017 | Clark et al. |
| 2005/0095619 A1 | 5/2005 | Davis et al. |
| 2006/0019328 A1 | 1/2006 | Sode |
| 2006/0195947 A1 | 8/2006 | Davis et al. |
| 2008/0220990 A1 | 9/2008 | Fox |
| 2009/0312196 A1 | 12/2009 | Colbeck et al. |
| 2011/0262977 A1 | 10/2011 | Nagasawa et al. |
| 2012/0178115 A1 | 7/2012 | Mano et al. |
| 2014/0242645 A1 | 8/2014 | Chung et al. |
| 2017/0073661 A1 | 3/2017 | Roedel et al. |
| 2018/0187221 A1 | 7/2018 | Chen et al. |
| 2020/0102546 A1 | 4/2020 | Yang et al. |

FOREIGN PATENT DOCUMENTS

| | | |
|---|---|---|
| WO | 95/22625 A1 | 8/1995 |
| WO | 95/33836 A1 | 12/1995 |
| WO | 96/00787 A1 | 1/1996 |
| WO | 97/0078 A1 | 1/1997 |
| WO | 97/35966 A1 | 10/1997 |
| WO | 98/27230 A1 | 6/1998 |
| WO | 00/42651 A1 | 7/2000 |
| WO | 01/75767 A2 | 10/2001 |
| WO | 2005/045016 A2 | 5/2005 |
| WO | 2006/0611374 A1 | 6/2006 |
| WO | 2009/008908 A2 | 1/2009 |
| WO | 2009/152336 A1 | 12/2009 |
| WO | 2010/144103 A1 | 12/2010 |
| WO | 2018/036982 A1 | 3/2018 |

OTHER PUBLICATIONS

Stenico, M., et al., "Codon usage in Caenorhabditis elegans: delineation of translational selection and mutational piases," Nucl. Acids Res. 22(13):2437-46 [1994].

Suggs, S.V., et al., "Use of synthetic oligodeoxyribonucleotides for the isolation of specific cloned DNA sequences," In Developmental Biology Using Purified Genes (Brown et al., eds.), pp. 683-693, Academic Press (1981).

Tiwari, S., et al., "Prediction of probable genes by Fourier analysis of genomic sequences," Comput. Appl. Biosci. 13(3):263-270 [1997].

Truppo, M.D., et al., "Development of an Improved Immobilized CAL-B for the Enzymatic Resolution of a Key Intermediate to Odanacatib," Organic Process Research & Development, 15:1033-1035 (2011).

Uberbacher, E.C., et al., "Discovering and Understanding Genes in Human DNA Sequence Using GRAIL," Methods Enzymol., 266:259-281 [1996].

Villa-Komaroff, L., et al., "A bacterial clone synthesizing proinsulin," Proc. Natl Acad. Sci. USA, 75:3727-3731 (1978).

Wada, K., et al., "Codon usage tabulated from the GenBank genetic sequence data," Nucl. Acids Res., 20:2111-2118 (1992].

Wells, J.A., et al., "Cassette mutagenesis: an efficient method for generation of multiple mutations at defined sites," Gene, 34:315-323 (1985).

Wetmur, J. G., "DNA Probes: Applications of the Principles of Nucleic Acid Hybridization," Crit Rev Biochem Mol Biol, 26(3/4):227-259 (1991).

Wright, F., "The 'effective number of codons' used in a gene," Gene 87:23-29 [1990].

(56) References Cited

OTHER PUBLICATIONS

Yaegaki, K., et al., "Improved high-performance liquid chromatography method for quantitation of proline and hydroxyproline in biological materials," J Chromatogr., 356(1):163-70 [1986].
Yi, S., et al., "Covalent immobilization of omega-transaminase from Vibrio fluvialis JS17 on chitosan beads," Process Biochemistry 42(5): 895-898 (2007).
Zhang, J-H., et al., "Directed evolution of a fucosidase from a galactosidase by DNA shuffling and screening ," Proc. Nat. Acad. Sci., U.S.A., 94:4504-4509 (1997).
Zhao, H., et al., "Molecular evolution by staggered extension process (StEP) in vitro recombination," Nat. Biotechnol., 16:258-261 (1998).
Aleku, G.A., et al., "A reductive aminase from Aspergillus oryzae," Nat. Chem., 9:961-969 [2017].
Aleku, G.A., et al., "Kinetic Resolution and Deracemization of Racemic Amines Using a Reductive Aminase," ChemCatChem., 10(3):515-519 [2018].
Altschul, S., et al., "Basic local alignment search tool," J. Mol. Biol., 215: 403-410 (1990).
Altschul, S.F., et al., "Gapped BLAST and PSI-BLAST: a new generation of protein database search programs," Nucleic Acids Res., 25(17):3389-3402 (1997).
Baldino, Jr., F., et al., "High-Resolution in Situ Hybridization Histochemistry," Methods Enzymology, 168:761-777 (1989).
Batzer, M.A., "Erratum: Structure and variability of recently inserted Alu family members", Nucleic Acids Res 19:698-699 [1991].
Beaucage, S.L., et al., "Deoxynucleoside phosphoamidites-A new class of key intermediates for deoxypolynucleotide synthesis," Tetrahedron Letters, 22(20):1859-62 (1981).
Black, M.E., et al., "Creation of drug-specific herpes simplex virus type 1 thymidine kinase mutants for gene therapy," Proc Natl Acad Sci USA, 93:3525-3529 (1996).
Bolton, E.T., et al., "A General Method for the Iisolation of RNA Complementary to DNA," Proc. Natl. Acad. Sci. USA 48:1390 (1962).
Botstein, D., et al., "Strategies and applications of in vitro mutagenesis," Science, 229(4719):1193-1201 [1985].
Breslauer, K.J., et al., "Predicting DNA duplex stability from the base sequence," Proc. Natl. Acad. Sci. USA, 83:3746-3750 (1986).
Caldwell, R.C., et al., "Mutagenic PCR," PCR Methods Appl., 3:S136-S140 (1994).
Carter, P., "Site-directed mutagenesis," Biochem. J., 237:1-7 (1986).
Christians, F.C., et al., "Directed evolution of thymidine kinase for AZT phosphorylation using DNA family shuffling," Nat. Biotechnol., 17:259-264 (1999).
Crameri, A., et al., "DNA shuffling of a family of genes from diverse species accelerates directed evolution", Nature, 391:288-291 (1998).
Crameri, A., et al., "Improved green fluorescent protein by molecular evolution using DNA shuffling," Nat. Biotechnol., 14(3):315-319 (1996).
Crameri, A., et al., "Molecular evolution of an arsenate detoxification pathway by DNA shuffling," Nat. Biotechnol., 15(5):436-438 (1997).
Dale, S.J., et al., "Oligonucleotide-directed random mutagenesis using the phosphorothioate method," Methods Mol. Biol., 57:369-74 (1996).
De Boer, H.A., et al., "The tac promoter: A functional hybrid derived from the trp and lac promoters," Proc. Natl Acad. Sci. USA, 80: 21-25 (1983).
Fasman, G.D.,CRC Practical Handbook of Biochemistry and Molecular Biology, CRC Press, Boca Raton, FL, pp. 3-70 [1989].
France, S.P., et al., "Identification of Novel Bacterial Members of the Imine Reductase Enzyme Family that Perform Reductive Amination," ChemCatChem., 10(3):510-514 [2018].
Freier, S.M., et al., "Improved free-energy parameters for predictions of RNA duplex stability," Proc. Natl. Acad. Sci USA, 83:9373-9377 (1986).

Gand, M., et al., "Characterization of three novel enzymes with imine reductase activity," J. Mol. Catal. B: Enzym., 110:126-132 [2014].
Grogan, G., "Synthesis of chiral amines using redox biocatalysis," Curr. Opin. Chem. Biol., 43:15-22 [2018].
Guo, Z., et al., "3'-End-Forming Signals of Yeast mRNA," Mol. Cell. Biol., 15(11):5983-5990 [1995].
Henaut and Danchin in Neidhardt et al. [eds.], *Escherichia coli* and *Salmonella*, "Analysis and predictions from *Escherichia coli* Sequences, or *E. coli* in silico," ASM Press, Washington D.C., [1987], pp. 2047-2066.
Henikoff, S., et al., "Amino acid substitution matrices from protein blocks," Proc. Natl. Acad. Sci., 89:10915-10919 (1992).
Huber, T., et al., "Direct Reductive Amination of Ketones: Structure and Activity of S-Selective Imine Reductases from Streptomyces," Chem. Cat. Chem., 6(8):2248-2252 [2014].
Kierzek, R., et al., "Polymer-Supported RNA Synthesis and its Application to Test the Nearest-Neighbor Model for Duplex Stability," Biochemistry, 25:7840-7846 (1986).
Koszelewski, D., et al., "Immobilization of omega-transaminases by encapsulation in a sol-gel/celite matrix," Journal of Molecular Catalysis B: Enzymatic, 63: 39-44 (2010).
Kramer, B., et al., "Different base/base mismatches are corrected with different efficiencies by the methyl-directed DNA mismatch-repair system of *E. coli*," Cell, 38(3):879-887 [1984].
Ling, M., et al., "Approaches to DNA Mutagenesis: An Overview," Anal. Biochem., 254:157-78 (1997).
Martin, A.R., et al., "Characterization of free and immobilized (S)-aminotransferase for acetophenone production," Applied Microbiology and Biotechnology, 76(4): 843-851 (2007).
Mateo, C., et al., "Epoxy sepabeads: a novel epoxy support for stabilization of industrial enzymes via very intense multipoint covalent attachment," Biotechnology Progress 18(3):629-34 (2002).
Matthes, H.W.D., et al., "Simultaneous rapid chemical synthesis of over one hundred oligonucleotides on a microscale," Embo J., 3(4):801-05 (1984).
McInerney, J.O., "GCUA: general codon usage analysis, " Bioinformatics, 14(4):372-73 [1998].
Minshull, J., et al., "Protein evolution by molecular breeding," Curr. Op. Chem. Biol., 3(3):284-290 (1999).
Mitsukura, K., et al., "Purification and Characterization of a Novel (R)-Imine Reductase from *Streptomyces* sp. GF3587," Biosci. Biotech. Biochem., 75(9):1778-1782 [2011].
Nakamura, Y., et al., "Codon usage tabulated from international DNA sequence databases: status for the year 2000," Nucl. Acids Res., 28:292 [2000].
Needleman, S., et al., "A general method applicable to the search for similarities in the amino acid sequence of two proteins," J. Mol. Biol. 48:443-453 (1970).
Pearson, W.R., "Improved tools for biological sequence comparison," Proc. Nat'l. Acad. Sci. USA, 85:2444-2448 (1988).
Roiban, G. et al., "Efficient Biocatalytic Reductive Aminations by Extending the Imine Reductase Toolbox," ChemCatChem., 9(24):4475-4479 [2017].
Romanos, M.A., et al., "Foreign gene expression in yeast: a review," Yeast 8:423-488 [1992].
Roth, S., et al., "Extended Catalytic Scope of a Well-Known Enzyme: Asymmetric Reduction of Iminium Substrates by GlucoseDehydrogenase," ChemBioChem, 18:1703-1706 [2017].
Rychlik, W., et al., "Optimization of the annealing temperature for DNA amplification in vitro," Nucleic Acids Res, 18(21):6409-6412 (1990).
Sharma, M., et al., "A Mechanism for Reductive Amination Catalyzed by Fungal Reductive Aminases," ACS Catalysis, 8(12), 11534-11541 [2018].
Sharma, M., et al., "NAD(P)H-Dependent Dehydrogenases for the Asymmetric Reductive Amination of Ketones: Structure, Mechanism, Evolution and Application, "Adv.Synth.Catal., 359(12): 2011-2015 [2017].
Simonen, M., et al., "Protein Secretion in *Bacillus* Species," Microbiological Reviews, 57:109-137 (1993).
Smith, M., "In vitro mutagenesis," Ann. Rev. Genet., 19:423-462 (1985).

(56) References Cited

OTHER PUBLICATIONS

Smith, T., et al., "Comparison of Biosequences," Adv. Appl. Math, 2:482-489 (1981).

* cited by examiner

ENGINEERED GLUCOSE DEHYDROGENASES AND METHODS FOR THE REDUCTIVE AMINATION OF KETONE AND AMINE COMPOUNDS

The present application is a national stage application filed under 35 USC § 371 and claims priority to PCT International Application No. PCT/US2020/029517, filed Apr. 23, 2020, which claims priority to U.S. Pat. Appln. Ser. No. 62/841,666, filed on May 1, 2019, both of which are hereby incorporated by reference in their entirety for all purposes.

TECHNICAL FIELD

The present invention provides engineered glucose dehydrogenase polypeptides having imine reductase activity useful for the production of secondary amines, as well as compositions and methods utilizing these engineered polypeptides.

REFERENCE TO SEQUENCE LISTING, TABLE OR COMPUTER PROGRAM

The official copy of the Sequence Listing is submitted concurrently with the specification as an ASCII formatted text file via EFS-Web, with a file name of "CX2-188WO1_ST25.txt", a creation date of Apr. 22, 2020, and a size of 2,379,776 bytes. The Sequence Listing filed via EFS-Web is part of the specification and is incorporated in its entirety by reference herein.

BACKGROUND

Chiral secondary amines are important building blocks in the pharmaceutical industry. However, there are only a handful of biocatalytic routes known to produce this class of chiral amine compounds. The existing chemical methods use chiral boron reagents, transition metal based reductive methods, or protecting group strategies that require multi-step synthesis for the overall reduction of an imine.

There are a few reports in the literature of the biocatalytic synthesis of stable cyclic amines. Imine reductases or "IREDs" were purified and characterized from *Streptomyces* sp. GF3587 and GF3546 and shown to reduce 2-methyl-1-pyrroline stereoselectively (See, Mitsukura et al., Biosci. Biotech. Biochem., 75:1778-1782 [2011]); Huber et al. Chem. Cat. Chem., 6:2248-2252 [2014]). Reduction to acyclic amines and amino acids with alkyl groups has also been shown using native imine reductases (Gand et. al., J. Mol. Catal. B: Enzym., 110:126-132 [2014]). More recently other authors have reported IREDs, which have also been referred to as reductive amines (RedAm), that catalyze synthetically interesting reductive aminations (Grogan, Curr.Opin.Chem.Biol., 2018, 43, 15-22 France et al., Chem-CatChem., 2018, 10(3), 510-514 Aleku et al., Nat.Chem., 2017, 9, 961-969 and ChemCatChem., 2018, 10(3), 515-519 Sharma et al., *ACS Catalysis* 2018, 8(12), 11534-11541 and *Adv.Synth.Catal.*, 2017, 359(12), 2011-2015 Roiban et al., *ChemCatChem.*, 2017, 9(24), 4475-4479)

Glucose dehydrogenase (GDH), the original member of the short chain dehydrogenase reductase family, is well-known for its NAD(P)-dependent oxidation of D-glucose to gluconolactone. It has been widely used in nicotinamide cofactor regeneration. Recently, the promiscuous imine reductase activity of GDH in the asymmetric reduction of cyclic iminium salts to the cyclic chiral amine by a few GDH enzymes from different organisms was reported (Roth et al., ChemBioChem 2017, 18, 1703-1706). This preliminary report raises the question of whether, similar to IREDs, GDHs might be useful to produce a range of chiral secondary amines, including among others, acyclic amines, amino acid esters, and amino acids with alkyl chains.

SUMMARY

The present invention provides novel biocatalysts and associated methods of use for the synthesis of chiral secondary amines by direct reduction of imine substrates. The biocatalysts of the present disclosure are engineered polypeptide variants of the wild-type gene from *Bacillus subtilis*, which encodes a glucose dehydrogenase having the amino acid sequence of SEQ ID NO:2. A variant (SEQ ID NO:4) of the wild-type glucose dehydrogenase, containing the following residue differences compared to SEQ ID NO:2: E170K, Q252L, I165M, P194T, was used as the starting point for protein engineering. These engineered polypeptides are capable of catalyzing the conversion of an imine to a secondary amine.

The present invention provides an engineered polypeptide comprising an amino acid sequence with at least 80%, 85%, 90%, 91%, 92%, 93%, 94%, 95%, 96%, 97%, 98%, 99% sequence identity to a reference sequence of SEQ ID NO:4, comprising at least one substitution or one substitution set at one or more positions selected from 96, 96/118, 147, 155, 155/253, 195, 200, and 256, wherein the positions are numbered with reference to SEQ ID NO:4. In some additional embodiments, the engineered polypeptide comprises at least one substitution or one substitution set selected from 96A, 96C/118M, 147A, 147I, 147S, 155A/253H, 155N, 195G, 200W, 256A, 256S, 256T, and 256V, wherein the positions are numbered with reference to SEQ ID NO:4. In some embodiments, the engineered polypeptide comprises at least one substitution or one substitution set selected from E96A, E96C/T118M, H147A, H147I, H147S, F155A/Y253H, F155N, I195G, F200W, F256A, F256S, F256T, and F256V, wherein the positions are numbered with reference to SEQ ID NO:4. In some further embodiments, the engineered polypeptide comprises an amino acid sequence with at least 80% sequence identity to any even-numbered sequence set forth in SEQ ID NO:4 to SEQ ID NO:30.

The present invention also provides an engineered polypeptide comprising an amino acid sequence with at least 80%, 85%, 90%, 91%, 92%, 93%, 94%, 95%, 96%, 97%, 98%, 99% sequence identity to a reference sequence of SEQ ID NO:14, comprising at least one substitution or one substitution set selected from: 17, 95/96, 95/96/118, 95/96/118/156/200/253, 95/96/147, 95/96/147/200, 95/96/147/200/253, 95/96/155/156, 95/96/155/195/200, 95/96/159/195/253, 95/155/156, 95/155/159/200, 95/155/200, 96, 96/147/195/200/253, 96/155, 96/155/159, 96/155/159/195, 96/155/159/200, 96/156/159/195, 96/156/159/195/200, 96/195, 147, 147/155, 147/155/156, 147/155/156/200, 147/155/159, 147/195/200/253, 155, 155/156, 155/156/195/200/253, 155/159/200, and 253, wherein the positions are numbered with reference to SEQ ID NO:14. In some embodiments, the engineered polypeptide comprises at least one substitution or one substitution set selected from 17T, 95V/96A/118M/156T/200W/253H, 95V/96A/147Q/200W/253H, 95V/96C, 95V/96C/118M, 95V/96C/147Q, 95V/96C/147Q/200W, 95V/96C/155A/195G/200W, 95V/96C/155N/156Q, 95V/96C/159T/195G/253H, 95V/155N/156A, 95V/155N/159C/200W, 95V/155N/200W, 96A/147Q/195G/200W/253H, 96C/155A, 96C/155N/159C, 96C/

155N/159C/195G, 96C/155N/159C/200W, 96C/155N/ 159T, 96C/156A/159T/195G/200W, 96C/156L/159T/195G, 96C/195G, 96S, 147Q/155N, 147Q/155N/156A/200W, 147Q/155N/156T, 147Q/155N/159C, 147Q/195G/200W/ 253H, 147T, 155N, 155N/156A, 155N/156T/195G/200W/ 253H, 155N/159C/200W, 155Q, 155R, 253G, and 253S, wherein the positions are numbered with reference to SEQ ID NO:14. In some further embodiments, the engineered polypeptide comprises at least one substitution or one substitution set selected from S17T, L95V/E96A/T118M/ V156T/F200W/Y253H, L95V/E96A/I147Q/F200W/ Y253H, L95V/E96C, L95V/E96C/T118M, L95V/E96C/ I147Q, L95V/E96C/I147Q/F200W, L95V/E96C/F155A/ I195G/F200W, L95V/E96C/F155N/V156Q, L95V/E96C/ A159T/I195G/Y253H, L95V/F155N/V156A, L95V/ F155N/A159C/F200W, L95V/F155N/F200W, E96A/ I147Q/I195G/F200W/Y253H, E96C/F155A, E96C/F155N/ A159C, E96C/F155N/A159C/I195G, E96C/F155N/ A159C/F200W, E96C/F155N/A159T, E96C/V156A/ A159T/I195G/F200W, E96C/V156L/A159T/I195G, E96C/ I195G, E96S, I147Q/F155N, I147Q/F155N/V156A/F200W, I147Q/F155N/V156T, I147Q/F155N/A159C, I147Q/I195G/ F200W/Y253H, I147T, F155N, F155N/V156A, F155N/ V156T/I195G/F200W/Y253H, F155N/A159C/F200W, F155Q, F155R, Y253G, and Y253S, wherein the positions are numbered with reference to SEQ ID NO:14. In some further embodiments, the engineered polypeptide comprises an amino acid sequence with at least 80% sequence identity to any even-numbered sequence set forth in SEQ ID NO:32 to SEQ ID NO:104.

The present invention further provides an engineered polypeptide comprising an amino acid sequence with at least 80%, 85%, 90%, 91%, 92%, 93%, 94%, 95%, 96%, 97%, 98%, 99% sequence identity to a reference sequence of SEQ ID NO:34, comprising at least at least one substitution or one substitution set selected from 17, 17/21, 17/21/42, 17/21/42/155/260, 17/21/49, 17/21/49/51, 17/21/49/51/96, 17/21/49/51/260, 17/21/49/96/155/260, 17/21/49/260, 17/21/51/96, 17/21/51/195, 17/21/96, 17/21/96/155, 17/21/ 96/195/260, 17/21/96/253, 17/21/147/155/253, 17/21/155/ 253, 17/21/195, 17/21/253, 17/42, 17/42/49/195/260, 17/42/ 96, 17/44, 17/44/47/51/96, 17/44/47/51/96/114/147/195/ 199/253, 17/44/47/51/96/114/147/199, 17/44/47/51/96/114/ 195/199, 17/44/47/51/96/147/253, 17/44/47/51/178/195, 17/44/47/195/199, 17/44/51/114/195/253, 17/46/47/51/96/ 147, 17/46/47/51/96/195/253, 17/46/47/51/155, 17/46/47/ 51/155/195/199, 17/46/47/96/195, 17/46/47/178, 17/46/96/ 253, 17/47, 17/47/51, 17/47/51/96/114/147/195, 17/47/51/ 96/114/155/178/253, 17/47/51/96/195, 17/47/51/96/195/ 199, 17/47/96/114/155/253, 17/47/96/147/155/195/199, 17/47/96/147/195/199/253, 17/47/96/155, 17/47/96/195/ 199, 17/47/114, 17/47/114/155/195/199/253, 17/47/147/ 195/199/253, 17/49, 17/49/51, 17/49/51/96/195/253, 17/49/ 51/155/253, 17/49/51/155/253/260, 17/49/51/155/260, 17/49/51/253, 17/49/96, 17/49/96/155/253, 17/49/96/195, 17/49/260, 17/51, 17/51/96/114, 17/51/96/155/178, 17/51/ 96/155/195/199/253, 17/51/96/155/199, 17/51/96/155/253, 17/51/96/178/195/199, 17/51/96/195, 17/51/96/260, 17/51/ 114, 17/51/114/253, 17/51/147, 17/51/155/195, 17/51/178/ 195/253, 17/51/253, 17/96, 17/96/114/147/155, 17/96/114/ 147/155/178/195/199, 17/96/147, 17/96/147/155, 17/96/ 155/178, 17/96/155/178/253, 17/96/155/195, 17/96/155/ 195/199, 17/96/178, 17/96/178/195, 17/96/195, 17/96/195/ 199, 17/96/195/199/253, 17/96/253, 17/114, 17/114/253, 17/147/155/253, 17/147/178, 17/147/199, 17/155, 17/155/ 178, 17/155/178/195, 17/155/195, 17/155/195/253, 17/155/ 199, 17/155/253, 17/178, 17/178/195/253, 17/195, 17/195/ 199, 17/195/199/253, 17/195/253, 17/199, 17/253, 17/260, 21/49/51, 21/49/96/195, 21/49/96/253, 21/49/195, 21/51/96/ 155, 21/96, 21/96/195, 21/96/253, 44/46/47/51/114/178/ 253, 44/46/47/51/155/178/253, 44/46/47/96/155/195, 44/46/ 51/96/147/178/195/199, 44/46/51/96/155/195/199/253, 44/46/51/96/195, 44/46/51/147/155/178/195/253, 44/47/51/ 96/114, 44/47/51/96/177/178/199/253, 44/47/51/114/178/ 253, 44/47/96/114, 44/47/96/195/253, 44/47/147/155, 44/47/147/155/199, 44/96/155/178, 46/47/51/96/114/178, 46/47/51/114/147/195/199, 46/47/51/155/195/199, 46/47/ 96/114/195/199, 46/47/96/155/178/195/253, 46/47/155/195/ 199, 46/114/147/155/178/195/199, 46/114/195/199/253, 47/51/96, 47/51/96/114, 47/51/96/147/155/195/199, 47/51/ 96/147/195/199, 47/51/96/178/195/199/253, 47/51/96/195, 47/51/96/195/199/253, 47/51/114/253, 47/51/155/178/195, 47/51/155/195/253, 47/96/114, 47/96/114/253, 47/96/155/ 178/195, 47/96/155/195, 47/96/155/195/199, 47/96/178/ 195/253, 47/96/178/253, 47/96/195/199/253, 47/96/195/ 253, 47/114, 47/114/155/195/199, 47/114/178, 47/147/195, 47/155/253, 47/178/195, 47/178/195/199, 47/195/199, 49/51/96, 49/96, 49/96/253, 51/96, 51/96/114/155/195/199/ 253, 51/96/155/178, 51/96/155/178/195/253, 51/96/155/ 195, 51/96/155/195/253, 51/96/195/253, 51/96/199, 51/96/ 253, 51/114/155/195/199, 51/114/195/199, 51/147/253, 51/155/195/199, 51/195, 51/253, 96, 96/114/147/155/195/ 199, 96/114/155/178/195/199/253, 96/114/155/195/253, 96/114/199, 96/147, 96/147/155/178/195/253, 96/147/178/ 195/199, 96/147/195, 96/147/195/199, 96/147/253, 96/155/ 178/199, 96/155/195, 96/155/199, 96/155/253, 96/178/195, 96/178/195/199, 96/195, 96/195/199, 96/195/253, 96/199, 96/199/253, 96/253, 114, 114/147/155/253, 114/178/195/ 199/253, 114/195, 114/195/199/253, 132, 147/155, 149, 154, 155/178, 155/178/195/199, 155/195, 155/195/199, 155/ 195/199/253, 155/195/253, 155/253, 157, 167, 170, 178, 178/195, 178/199, 195, 196, 198, 214, 218, 251, 252, 256, 257, 259, and 260, wherein the positions are numbered with reference to SEQ ID NO:34. In some additional embodiments, the engineered polypeptide comprises at least one substitution or one substitution set selected from 17T, 17T/ 21R, 17T/21R/42T, 17T/21R/42T/155R/260G, 17T/21R/ 49A, 17T/21R/49A/51L, 17T/21R/49A/51L/96S, 17T/21R/ 49A/51L/260G, 17T/21R/49A/96S/155R/260G, 17T/21R/ 49A/260G, 17T/21R/51L/96S, 17T/21R/51L/195N, 17T/ 21R/96S, 17T/21R/96S/155R, 17T/21R/96S/195N/260G, 17T/21R/96S/253L, 17T/21R/147T/155R/253L, 17T/21R/ 155R/253L, 17T/21R/195N, 17T/21R/253L, 17T/42T, 17T/ 42T/49A/195N/260G, 17T/42T/96S, 17T/44N, 17T/44N/ 47A/51A/96A, 17T/44N/47A/195N/199R, 17T/44N/47L/ 51A/96A/114A/147T/195G/199R/253G, 17T/44N/47L/ 51A/96S/114A/147T/199R, 17T/44N/47L/51A/96T/114A/ 195G/199R, 17T/44N/47S/51A/96T/147T/253G, 17T/44N/ 47S/51A/178S/195N, 17T/44N/47S/195G/199R, 17T/44N/ 51A/114A/195N/253G, 17T/46W/47A/96C/195G, 17T/ 46W/47A/178S, 17T/46W/47L/51A/96C/195G/253R, 17T/ 46W/47L/51A/96T/147T, 17T/46W/47L/51A/155Q, 17T/ 46W/47L/51A/155R/195G/199R, 17T/46W/96C/253G, 17T/47A/51A, 17T/47A/51A/96T/114A/147T/195G, 17T/ 47A/51A/96T/114A/155R/178S/253R, 17T/47A/96A/ 155Q, 17T/47A/96T/147T/195G/199R/253G, 17T/47A/ 147T/195G/199R/253S, 17T/47L/51A/96T/195G, 17T/47L/ 51A/96T/195G/199R, 17T/47L/96A/114A/155Q/253G, 17T/47L/114A, 17T/47L/114A/155R/195G/199R/253S, 17T/47S, 17T/47S/96C/147T/155Q/195G/199R, 17T/47S/ 96C/195N/199R, 17T/49A, 17T/49A/51L, 17T/49A/51L/ 96S/195N/253L, 17T/49A/51L/155R/253L, 17T/49A/51L/ 155R/253L/260G, 17T/49A/51L/155R/260G, 17T/49A/ 51L/253L, 17T/49A/96S, 17T/49A/96S/155R/253L, 17T/

49A/96S/195N, 17T/49A/260G, 17T/51A/96C/155Q/195G/ 199R/253G, 17T/51A/96C/155R/178S, 17T/51A/96C/ 195N, 17T/51A/96S/114A, 17T/51A/96S/155Q/199R, 17T/ 51A/96T/155R/195G/199R/253S, 17T/51A/96T/178S/ 195G/199R, 17T/51A/114A, 17T/51A/114A/253R, 17T/ 51A/147T, 17T/51A/155R/195G, 17T/51A/178S/195G/ 253G, 17T/51L, 17T/51L/96S/155R/253L, 17T/51L/96S/ 260G, 17T/51L/253L, 17T/96A/147T/155R, 17T/96A/ 155Q/195G/199R, 17T/96A/155R/178S/253G, 17T/96A/ 195N/199R, 17T/96C, 17T/96C/114A/147T/155Q, 17T/ 96C/178S/195G, 17T/96C/195G/199R, 17T/96S/114A/ 147T/155Q/178S/195G/199R, 17T/96S/155R/178S, 17T/ 96S/155R/195N, 17T/96S/178S, 17T/96S/195N, 17T/96S/ 253L, 17T/96T, 17T/96T/147T, 17T/96T/195G/199R, 17T/ 96T/195G/199R/253R, 17T/96T/253R, 17T/114A, 17T/ 114A/253R, 17T/147T/155Q/253G, 17T/147T/178S, 17T/ 147T/199R, 17T/155Q, 17T/155Q/178S, 17T/155Q/195G/ 253S, 17T/155Q/199R, 17T/155R, 17T/155R/178S, 17T/ 155R/178S/195G, 17T/155R/195G, 17T/155R/253G, 17T/ 155R/253L, 17T/178S, 17T/178S/195N/253S, 17T/195G, 17T/195G/199R, 17T/195G/199R/253S, 17T/195N, 17T/ 195N/199R, 17T/195N/253L, 17T/199R, 17T/253L, 17T/ 260G, 21R/49A/51L, 21R/49A/96S/195N, 21R/49A/96S/ 253L, 21R/49A/195N, 21R/51L/96S/155R, 21R/96S, 21R/ 96S/195N, 21R/96S/253L, 44N/46W/47A/51A/155R/178S/ 253G, 44N/46W/47L/51A/114A/178S/253G, 44N/46W/ 47L/96C/155R/195G, 44N/46W/51A/96A/147T/178S/ 195G/199R, 44N/46W/51A/96T/155R/195G/199R/253G, 44N/46W/51A/96T/195G, 44N/46W/51A/147T/155R/ 178S/195G/253G, 44N/47A/51A/96T/177T/178S/199R/ 253S, 44N/47L/96T/114A, 44N/47S/51A/96S/114A, 44N/ 47S/51A/114A/178S/253S, 44N/47S/96T/195N/253G, 44N/47S/147T/155Q, 44N/47S/147T/155Q/199R, 44N/ 96C/155R/178S, 46W/47A/51A/114A/147T/195G/199R, 46W/47A/51A/155R/195G/199R, 46W/47L/51A/96T/ 114A/178S, 46W/47L/96C/155R/178S/195G/253S, 46W/ 47L/96T/114A/195N/199R, 46W/47L/155R/195N/199R, 46W/114A/147T/155Q/178S/195G/199R, 46W/114A/ 195G/199R/253S, 47A/51A/96C/178S/195G/199R/253G, 47A/51A/96T/195G, 47A/51A/155R/195G/253G, 47A/ 96S/114A, 47A/96S/195N/253S, 47A/96T/155Q/178S/ 195G, 47A/96T/155Q/195N/199R, 47A/96T/178S/195N/ 253R, 47A/114A, 47A/147T/195G, 47A/178S/195N/199R, 47L/51A/96C/147T/195G/199R, 47L/51A/96C/195G/ 199R/253G, 47L/51A/96S/147T/155Q/195G/199R, 47L/ 51A/155Q/195G/253S, 47L/96A/195G/199R/253S, 47L/ 96T/114A/253R, 47L/96T/178S/253G, 47L/114A/155R/ 195G/199R, 47L/114A/178S, 47L/195N/199R, 47S/51A/ 96A, 47S/51A/96C/114A, 47S/51A/96C/195G, 47S/51A/ 114A/253S, 47S/51A/155R/178S/195N, 47S/96S/155R/ 195G, 47S/96T/195G/253S, 47S/155R/253G, 47S/178S/ 195G, 49A/51A/96S, 49A/96S, 49A/96S/253L, 51A/96C/ 114A/155Q/195G/199R/253G, 51A/96C/155Q/195G/253G, 51A/96C/155R/178S, 51A/96C/155R/178S/195G/253R, 51A/96S/155Q/195G, 51A/96S/199R, 51A/96T/195G/ 253G, 51A/96T/199R, 51A/96T/253R, 51A/114A/155Q/ 195G/199R, 51A/114A/195G/199R, 51A/147T/253S, 51A/ 155Q/195N/199R, 51A/195G, 51A/195N, 51A/253G, 51L/ 96S, 51L/195N, 96A, 96A/114A/155R/178S/195G/199R/ 253G, 96A/147T, 96A/147T/155R/178S/195G/253G, 96A/ 147T/195G, 96A/147T/195G/199R, 96A/147T/253R, 96A/ 195G, 96A/195G/199R, 96C, 96C/114A/147T/155R/195G/ 199R, 96C/147T/195G/199R, 96C/155R/195G, 96C/178S/ 195G/199R, 96C/195G/199R, 96C/199R, 96C/253S, 96G, 96K, 96N, 96S, 96S/114A/155Q/195N/253S, 96S/147T, 96S/155R/253L, 96S/195N, 96S/195N/253L, 96S/253G, 96S/253S, 96T, 96T/114A/199R, 96T/147T/178S/195N/

199R, 96T/155Q/178S/199R, 96T/155Q/199R, 96T/178S/ 195G, 96T/178S/195N, 96T/195G, 96T/195G/253G, 96T/ 195G/253R, 96T/195N/199R, 96T/199R, 96T/199R/253S, 96T/253G, 114A, 114A/147T/155Q/253S, 114A/178S/ 195G/199R/253S, 114A/195G, 114A/195G/199R/253G, 132L, 147T/155R, 149D, 149E, 154E, 155Q/178S, 155Q/ 178S/195G/199R, 155Q/178S/195N/199R, 155Q/195G/ 253G, 155Q/195N, 155Q/195N/199R, 155R/195G/199R/ 253G, 155R/195N/199R/253R, 155R/195N/253L, 155R/ 253S, 157N, 167G, 167Q, 170Q, 178A, 178G, 178K, 178S, 178S/195N, 178S/199R, 195G, 195N, 195R, 195S, 196G, 196H, 198H, 214G, 218P, 251A, 251L, 252A, 252T, 256I, 257E, 257W, 259D, 259E, and 260E, wherein the positions are numbered with reference to SEQ ID NO:34. In some further embodiments, the engineered polypeptide comprises at least at least one substitution or one substitution set selected from S17T, S17T/K21R, S17T/K21R/K42T, S17T/ K21R/K42T/N155R/R260G, S17T/K21R/K49A, S17T/ K21R/K49A/E51L, S17T/K21R/K49A/E51L/E96S, S17T/ K21R/K49A/E51L/R260G, S17T/K21R/K49A/E96S/ N155R/R260G, S17T/K21R/K49A/R260G, S17T/K21R/ E51L/E96S, S17T/K21R/E51L/I195N, S17T/K21R/E96S, S17T/K21R/E96S/N155R, S17T/K21R/E96S/195N/ R260G, S17T/K21R/E96S/Y253L, S17T/K21R/I147T/ N155R/Y253L, S17T/K21R/N155R/Y253L, S17T/K21R/ I195N, S17T/K21R/Y253L, S17T/K42T, S17T/K42T/ K49A/I195N/R260G, S17T/K42T/E96S, S17T/D44N, S17T/D44N/E47A/E51A/E96A, S17T/D44N/E47A/I195N/ K199R, S17T/D44N/E47L/E51A/E96A/G114A/I147T/ I195G/K199R/Y253G, S17T/D44N/E47L/E51A/E96S/ G114A/I147T/K199R, S17T/D44N/E47L/E51A/E96T/ G114A/I195G/K199R, S17T/D44N/E47S/E51A/E96T/ I147T/Y253G, S17T/D44N/E47S/E51A/P178S/I195N, S17T/D44N/E47S/I195G/K199R, S17T/D44N/E51A/ G114A/I195N/Y253G, S17T/N46W/E47A/E96C/I195G, S17T/N46W/E47A/P178S, S17T/N46W/E47L/E51A/ E96C/I195G/Y253R, S17T/N46W/E47L/E51A/E96T/ I147T, S17T/N46W/E47L/E51A/N155Q, S17T/N46W/ E47L/E51A/N155R/I195G/K199R, S17T/N46W/E96C/ Y253G, S17T/E47A/E51A, S17T/E47A/E51A/E96T/ G114A/I147T/I195G, S17T/E47A/E51A/E96T/G114A/ N155R/P178S/Y253R, S17T/E47A/E96A/N155Q, S17T/ E47A/E96T/I147T/I195G/K199R/Y253G, S17T/E47A/ I147T/I195G/K199R/Y253S, S17T/E47L/E51A/E96T/ I195G, S17T/E47L/E51A/E96T/I195G/K199R, S17T/ E47L/E96A/G114A/N155Q/Y253G, S17T/E47L/G114A, S17T/E47L/G114A/N155R/I195G/K199R/Y253S, S17T/ E47S, S17T/E47S/E96C/I147T/N155Q/I195G/K199R, S17T/E47S/E96C/I195N/K199R, S17T/K49A, S17T/ K49A/E51L, S17T/K49A/E51L/E96S/I195N/Y253L, S17T/K49A/E51L/N155R/Y253L, S17T/K49A/E51L/ N155R/Y253L/R260G, S17T/K49A/E51L/N155R/R260G, S17T/K49A/E51L/Y253L, S17T/K49A/E96S, S17T/K49A/ E96S/N155R/Y253L, S17T/K49A/E96S/I195N, S17T/ K49A/R260G, S17T/E51A/E96C/N155Q/I195G/K199R/ Y253G, S17T/E51A/E96C/N155R/P178S, S17T/E51A/ E96C/I195N, S17T/E51A/E96S/G114A, S17T/E51A/E96S/ N155Q/K199R, S17T/E51A/E96T/N155R/I195G/K199R/ Y253S, S17T/E51A/E96T/P178S/I195G/K199R, S17T/ E51A/G114A, S17T/E51A/G114A/Y253R, S17T/E51A/ I147T, S17T/E51A/N155R/I195G, S17T/E51A/P178S/ I195G/Y253G, S17T/E51L, S17T/E51L/E96S/N155R/ Y253L, S17T/E51L/E96S/R260G, S17T/E51L/Y253L, S17T/E96A/I147T/N155R, S17T/E96A/N155Q/I195G/ K199R, S17T/E96A/N155R/P178S/Y253G, S17T/E96A/ I195N/K199R, S17T/E96C, S17T/E96C/G114A/I147T/ N155Q, S17T/E96C/P178S/I195G, S17T/E96C/I195G/

K199R, S17T/E96S/G114A/I147T/N155Q/P178S/I195G/ K199R, S17T/E96S/N155R/P178S, S17T/E96S/N155R/ I195N, S17T/E96S/P178S, S17T/E96S/I195N, S17T/E96S/ Y253L, S17T/E96T, S17T/E96T/I147T, S17T/E96T/I195G/ K199R, S17T/E96T/I195G/K199R/Y253R, S17T/E96T/ Y253R, S17T/G114A, S17T/G114A/Y253R, S17T/I147T/ N155Q/Y253G, S17T/I147T/P178S, S17T/I147T/K199R, S17T/N155Q, S17T/N155Q/P178S, S17T/N155Q/I195G/ Y253S, S17T/N155Q/K199R, S17T/N155R, S17T/N155R/ P178S, S17T/N155R/P178S/I195G, S17T/N155R/I195G, S17T/N155R/Y253G, S17T/N155R/Y253L, S17T/P178S, S17T/P178S/I195N/Y253S, S17T/I195G, S17T/I195G/ K199R, S17T/I195G/K199R/Y253S, S17T/I195N, S17T/ I195N/K199R, S17T/I195N/Y253L, S17T/K199R, S17T/ Y253L, S17T/R260G, K21R/K49A/E51L, K21R/K49A/ E96S/I195N, K21R/K49A/E96S/Y253L, K21R/K49A/ I195N, K21R/E51L/E96S/N155R, K21R/E96S, K21R/ E96S/I195N, K21R/E96S/Y253L, D44N/N46W/E47A/ E51A/N155R/P178S/Y253G, D44N/N46W/E47L/E51A/ G114A/P178S/Y253G, D44N/N46W/E47L/E96C/N155R/ I195G, D44N/N46W/E51A/E96A/I147T/P178S/I195G/ K199R, D44N/N46W/E51A/E96T/N155R/I195G/K199R/ Y253G, D44N/N46W/E51A/E96T/I195G, D44N/N46W/ E51A/I147T/N155R/P178S/I195G/Y253G, D44N/E47A/ E51A/E96T/A177T/P178S/K199R/Y253S, D44N/E47L/ E96T/G114A, D44N/E47S/E51A/E96S/G114A, D44N/ E47S/E51A/G114A/P178S/Y253S, D44N/E47S/E96T/ I195N/Y253G, D44N/E47S/I147T/N155Q, D44N/E47S/ I147T/N155Q/K199R, D44N/E96C/N155R/P178S, N46W/ E47A/E51A/G114A/I147T/I195G/K199R, N46W/E47A/ E51A/N155R/I195G/K199R, N46W/E47L/E51A/E96T/ G114A/P178S, N46W/E47L/E96C/N155R/P178S/I195G/ Y253S, N46W/E47L/E96T/G114A/I195N/K199R, N46W/ E47L/N155R/I195N/K199R, N46W/G114A/I147T/N155Q/ P178S/I195G/K199R, N46W/G114A/I195G/K199R/ Y253S, E47A/E51A/E96C/P178S/I195G/K199R/Y253G, E47A/E51A/E96T/I195G, E47A/E51A/N155R/I195G/ Y253G, E47A/E96S/G114A, E47A/E96S/I195N/Y253S, E47A/E96T/N155Q/P178S/I195G, E47A/E96T/N155Q/ I195N/K199R, E47A/E96T/P178S/I195N/Y253R, E47A/ G114A, E47A/I147T/I195G, E47A/P178S/I195N/K199R, E47L/E51A/E96C/I147T/I195G/K199R, E47L/E51A/ E96C/I195G/K199R/Y253G, E47L/E51A/E96S/I147T/ N155Q/I195G/K199R, E47L/E51A/N155Q/I195G/Y253S, E47L/E96A/I195G/K199R/Y253S, E47L/E96T/G114A/ Y253R, E47L/E96T/P178S/Y253G, E47L/G114A/N155R/ I195G/K199R, E47L/G114A/P178S, E47L/I195N/K199R, E47S/E51A/E96A, E47S/E51A/E96C/G114A, E47S/E51A/ E96C/I195G, E47S/E51A/G114A/Y253S, E47S/E51A/ N155R/P178S/I195N, E47S/E96S/N155R/I195G, E47S/ E96T/I195G/Y253S, E47S/N155R/Y253G, E47S/P178S/ I195G, K49A/E51L/E96S, K49A/E96S, K49A/E96S/ Y253L, E51A/E96C/G114A/N155Q/I195G/K199R/ Y253G, E51A/E96C/N155Q/I195G/Y253G, E51A/E96C/ N155R/P178S, E51A/E96C/N155R/P178S/I195G/Y253R, E51A/E96S/N155Q/I195G, E51A/E96S/K199R, E51A/ E96T/I195G/Y253G, E51A/E96T/K199R, E51A/E96T/ Y253R, E51A/G114A/N155Q/I195G/K199R, E51A/ G114A/I195G/K199R, E51A/I147T/Y253S, E51A/ N155Q/I195N/K199R, E51A/I195G, E51A/I195N, E51A/ Y253G, E51L/E96S, E51L/I195N, E96A, E96A/G114A/ N155R/P178S/I195G/K199R/Y253G, E96A/I147T, E96A/ I147T/N155R/P178S/I195G/Y253G, E96A/I147T/I195G, E96A/I147T/I195G/K199R, E96A/I147T/Y253R, E96A/ I195G, E96A/I195G/K199R, E96C, E96C/G114A/I147T/ N155R/I195G/K199R, E96C/I147T/I195G/K199R, E96C/ N155R/I195G, E96C/P178S/I195G/K199R, E96C/I195G/ K199R, E96C/K199R, E96C/Y253S, E96G, E96K, E96N, E96S, E96S/G114A/N155Q/I195N/Y253S, E96S/I147T, E96S/N155R/Y253L, E96S/I195N, E96S/I195N/Y253L, E96S/Y253G, E96S/Y253S, E96T, E96T/G114A/K199R, E96T/I147T/P178S/I195N/K199R, E96T/N155Q/P178S/ K199R, E96T/N155Q/K199R, E96T/P178S/I195G, E96T/ P178S/I195N, E96T/I195G, E96T/I195G/Y253G, E96T/ I195G/Y253R, E96T/I195N/K199R, E96T/K199R, E96T/ K199R/Y253S, E96T/Y253G, G114A, G114A/I147T/ N155Q/Y253S, G114A/P178S/I195G/K199R/Y253S, G114A/I195G, G114A/I195G/K199R/Y253G, V132L, I147T/N155R, V149D, V149E, L154E, N155Q/P178S, N155Q/P178S/I195G/K199R, N155Q/P178S/I195N/ K199R, N155Q/I195G/Y253G, N155Q/I195N, N155Q/ I195N/K199R, N155R/I195G/K199R/Y253S, N155R/ I195N/K199R/Y253R, N155R/I195N/Y253L, N155R/ Y253S, H157N, L167G, L167Q, K170Q, P178A, P178G, P178K, P178S, P178S/I195N, P178S/K199R, I195G, I195N, I195R, I195S, N196G, N196H, E198H, P214G, I218P, T251A, T251L, L252A, L252T, F256I, Q257E, Q257W, G259D, G259E, and R260E, wherein the positions are numbered with reference to SEQ ID NO:34. In some additional embodiments, the engineered polypeptide comprises an amino acid sequence with at least 80% sequence identity to any even-numbered sequence set forth in SEQ ID NO:106 to SEQ ID NO:702.

The present invention provides an engineered polypeptide comprising an amino acid sequence with at least 80%, 85%, 90%, 91%, 92%, 93%, 94%, 95%, 96%, 97%, 98%, 99% sequence identity to a reference sequence of SEQ ID NO:112, comprising at least one substitution or one substitution set at one or more positions selected from 21/42/96/ 178/195/253, 21/42/96/195, 21/96, 21/96/147/195, 21/96/ 149, 21/96/155/195/253, 21/96/167, 21/96/167/195, 21/96/ 178, 21/96/179/195/251/253, 21/96/195, 21/147/149, 21/147/253, 21/149/178/195, 21/155/178/253/256, 21/178/ 195/256, 42/96/149/253/256, 94, 96, 96/114/155/198/218/ 253/256/257, 96/114/155/252/253/257, 96/114/155/253, 96/114/196/214/253/256, 96/114/214/253/256, 96/147, 96/147/149, 96/147/149/155, 96/147/167/195, 96/149/155/ 167/178/253, 96/149/155/195, 96/149/178/179/251/256, 96/149/178/253, 96/149/198/252/253/257, 96/155, 96/155/ 167, 96/155/167/178, 96/155/195, 96/155/196/218/253/256/ 257, 96/155/196/252/253, 96/155/198, 96/155/252/253, 96/167, 96/178, 96/178/179/195, 96/195, 96/196, 96/196/ 198, 96/196/201/256, 96/251/253/256, 96/253/257, 96/256/ 257, 98, 103, 114/253/256/257, 147, 147/149, 149/167, 149/195, 149/218, 149/253, 149/257, 155/167, 155/178/195, 155/178/195/251/253, 155/195/251/253/256, 155/195/253/ 256, 155/196/198/253, 167, 167/195, 167/195/251/253, 196, 196/253/256/257, 198/253/256, 198/256, 205, 214/253/256, 251, and 257, wherein the positions are numbered with reference to SEQ ID NO:112. In some additional embodiments, the engineered polypeptide comprises at least one substitution or one substitution set selected from 21R/42T/ 96C/178S/195N/253G, 21R/42T/96S/195R, 21R/96C/ 147T/195R, 21R/96C/149E, 21R/96C/178S, 21R/96C/ 195R, 21R/96G/155N/195R/253G, 21R/96G/167Q/195N, 21R/96K/167Q, 21R/96S, 21R/96S/178S, 21R/96S/179N/ 195N/251A/253G, 21R/147T/149E, 21R/147T/253G, 21R/ 149E/178S/195N, 21R/155N/178S/253G/256I, 21R/178S/ 195R/256I, 42T/96C/149E/253G/256I, 94A, 96A/149E/ 155N/167Q/178S/253G, 96A/155N/167Q, 96C, 96C/114G/ 155N/252A/253G/257W, 96C/114G/155N/253R, 96C/ 114G/196G/214G/253G/256I, 96C/147T, 96C/147T/149E/ 155C, 96C/147T/167Q/195N, 96C/149D/198H/252A/ 253R/257E, 96C/149E/155N/195N, 96C/149E/155N/195R, 96C/155N/196G/218P/253G/256I/257E, 96C/155N/196G/ 252T/253G, 96C/155N/198H, 96C/155N/252T/253R, 96C/ 195N, 96C/196G/198H, 96C/196G/201P/256I, 96G/149E/ 178S/253G, 96G/155N/167Q, 96G/155N/195R, 96K/155N, 96K/178S, 96S, 96S/114G/155N/198H/218P/253R/256I/ 257E, 96S/114G/214G/253G/256I, 96S/147T/149E, 96S/ 149E/178S/179N/251A/256I, 96S/155N, 96S/155N/167Q/ 178S, 96S/167Q, 96S/178S, 96S/178S/179N/195N, 96S/ 195N, 96S/196G, 96S/251A/253G/256I, 96S/253G/257E, 96S/256I/257E, 98A, 103L, 114G/253G/256I/257E, 147A, 147R, 147T, 147T/149E, 149D/257E, 149E/167Q, 149E/ 195N, 149E/218P, 149E/253G, 155N/167Q, 155N/178S/ 195R, 155N/178S/195R/251A/253G, 155N/195N/251A/ 253G/256I, 155N/195N/253G/256I, 155N/196G/198H/ 253G, 167Q, 167Q/195N, 167Q/195N/251A/253G, 196A, 196G/253G/256I/257W, 198H/253G/256I, 198H/256I, 205E, 214G/253G/256I, 251L, and 257E, wherein the positions are numbered with reference to SEQ ID NO:112. In some embodiments, the engineered polypeptide comprises at least one substitution or one substitution set selected from K21R/K42T/E96C/P178S/G195N/S253G, K21R/K42T/ E96S/G195R, K21R/E96C/I147T/G195R, K21R/E96C/ V149E, K21R/E96C/P178S, K21R/E96C/G195R, K21R/ E96G/R155N/G195R/S253G, K21R/E96G/L167Q/G195N, K21R/E96K/L167Q, K21R/E96S, K21R/E96S/P178S, K21R/E96S/K179N/G195N/T251A/S253G, K21R/I147T/ V149E, K21R/I147T/S253G, K21R/V149E/P178S/G195N, K21R/R155N/P178S/S253G/F256I, K21R/P178S/G195R/ F256I, K42T/E96C/V149E/S253G/F256I, G94A, E96A/ V149E/R155N/L167Q/P178S/S253G, E96A/R155N/ L167Q, E96C, E96C/A114G/R155N/L252A/S253G/ Q257W, E96C/A114G/R155N/S253R, E96C/A114G/ N196G/P214G/S253G/F256I, E96C/I147T, E96C/I147T/ V149E/R155C, E96C/I147T/L167Q/G195N, E96C/V149D/ E198H/L252A/S253R/Q257E, E96C/V149E/R155N/ G195N, E96C/V149E/R155N/G195R, E96C/R155N/ N196G/I218P/S253G/F256I/Q257E, E96C/R155N/N196G/ L252T/S253G, E96C/R155N/E198H, E96C/R155N/L252T/ S253R, E96C/G195N, E96C/N196G/E198H, E96C/N196G/ A201P/F256I, E96G/V149E/P178S/S253G, E96G/R155N/ L167Q, E96G/R155N/G195R, E96K/R155N, E96K/P178S, E96S, E96S/A114G/R155N/E198H/I218P/S253R/F256I/ Q257E, E96S/A114G/P214G/S253G/F256I, E96S/I147T/ V149E, E96S/V149E/P178S/K179N/T251A/F256I, E96S/ R155N, E96S/R155N/L167Q/P178S, E96S/L167Q, E96S/ P178S, E96S/P178S/K179N/G195N, E96S/G195N, E96S/ N196G, E96S/T251A/S253G/F256I, E96S/S253G/Q257E, E96S/F256I/Q257E, P98A, E103L, A114G/S253G/F256I/ Q257E, I147A, I147R, I147T, I147T/V149E, V149D/ Q257E, V149E/L167Q, V149E/G195N, V149E/I218P, V149E/S253G, R155N/L167Q, R155N/P178S/G195R, R155N/P178S/G195R/T251A/S253G, R155N/G195N/ T251A/S253G/F256I, R155N/G195N/S253G/F256I, R155N/N196G/E198H/S253G, L167Q, L167Q/G195N, L167Q/G195N/T251A/S253G, N196A, N196G/S253G/ F256I/Q257W, E198H/S253G/F256I, E198H/F256I, Q205E, P214G/S253G/F256I, T251L, and Q257E, wherein the positions are numbered with reference to SEQ ID NO:112. In some additional embodiments, the engineered polypeptide comprises an amino acid sequence with at least 80% sequence identity to any even-numbered sequence set forth in SEQ ID NO:704 to SEQ ID NO:876.

The present invention provides an engineered polypeptide comprising an amino acid sequence with at least 80%, 85%, 90%, 91%, 92%, 93%, 94%, 95%, 96%, 97%, 98%, 99% sequence identity to a reference sequence of SEQ ID NO:736, comprising at least one substitution or one substitution set at one or more positions selected from 21/47/96/ 114/155/251, 21/47/149/257, 21/47/155/178/257, 21/47/ 178, 21/47/178/251/256/257, 21/96/114/155/178, 21/114/ 155/251/257, 21/114/178/179, 21/155/178/209/256, 25/155, 25/178/256, 42/47/155/178, 47/114/149/178/251, 47/114/ 178/257, 47/149, 47/178, 47/178/179/251/257, 47/178/251/ 257, 96/114/155/198, 96/114/155/253/257, 96/253, 114/149/ 155/251/256, 114/149/178/256/257, 114/155/195/198/256, 114/209/256/257, 149, 149/256/257, 155, 155/178/179, 155/ 178/198/252/253, 155/195/198, 155/195/198/253/256/257, 155/256/257, 178/253, 178/256, 179/256/257, 251, and 253, wherein the positions are numbered with reference to SEQ ID NO:736. In some additional embodiments, the engineered polypeptide comprises at least one substitution or one substitution set selected from 21R/47A/96A/114G/155N/ 251A, 21R/47A/149E/257E, 21R/47A/155N/178S/257E, 21R/47A/178S, 21R/47A/178S/251A/256I/257W, 21R/ 96A/114G/155N/178S, 21R/114G/155N/251A/257E, 21R/ 114G/178S/179N, 21R/155N/178S/209L/256I, 25L/155N, 25L/178S/256I, 42T/47A/155N/178S, 47A/114G/149E/ 178S/251A, 47A/114G/178S/257E, 47A/149E, 47A/178S, 47A/178S/179N/251A/257E, 47A/178S/251A/257E, 96T/ 114G/155N/198L, 96T/114G/155N/253G/257W, 96T/ 253G, 114G/149E/155N/251A/256I, 114G/149E/178S/ 256I/257E, 114G/155N/195N/198L/256I, 114G/209L/256I/ 257E, 149E, 149E/256I/257E, 155N, 155N/178S/179N, 155N/178S/198H/252T/253G, 155N/195N/198H/253G/ 256I/257W, 155N/195N/198L, 155N/256I/257E, 178S/ 253G, 178S/256I, 179N/256I/257E, 251I, 251L, and 253G, wherein the positions are numbered with reference to SEQ ID NO:736. In some embodiments, the engineered polypeptide comprises at least one substitution or one substitution set selected from K21R/L47A/E96A/A114G/R155N/ T251A, K21R/L47A/V149E/Q257E, K21R/L47A/R155N/ P178S/Q257E, K21R/L47A/P178S, K21R/L47A/P178S/ T251A/F256I/Q257W, K21R/E96A/A114G/R155N/P178S, K21R/A114G/R155N/T251A/Q257E, K21R/A114G/ P178S/K179N, K21R/R155N/P178S/V209L/F256I, I25L/ R155N, I25L/P178S/F256I, K42T/L47A/R155N/P178S, L47A/A114G/V149E/P178S/T251A, L47A/A114G/P178S/ Q257E, L47A/V149E, L47A/P178S, L47A/P178S/K179N/ T251A/Q257E, L47A/P178S/T251A/Q257E, E96T/A114G/ R155N/E198L, E96T/A114G/R155N/S253G/Q257W, E96T/S253G, A114G/V149E/R155N/T251A/F256I, A114G/V149E/P178S/F256I/Q257E, A114G/R155N/ G195N/E198L/F256I, A114G/V209L/F256I/Q257E, V149E, V149E/F256I/Q257E, R155N, R155N/P178S/ K179N, R155N/P178S/E198H/L252T/S253G, R155N/ G195N/E198H/S253G/F256I/Q257W, R155N/G195N/ E198L, R155N/F256I/Q257E, P178S/S253G, P178S/F256I, K179N/F256I/Q257E, T251I, T251L, and S253G, wherein the positions are numbered with reference to SEQ ID NO:736. In some additional embodiments, the engineered polypeptide comprises an amino acid sequence with at least 80% sequence identity to any even-numbered sequence set forth in SEQ ID NO:878 to SEQ ID NO:954.

The present invention provides an engineered polypeptide comprising an amino acid sequence with at least 80%, 85%, 90%, 91%, 92%, 93%, 94%, 95%, 96%, 97%, 98%, 99% sequence identity to a reference sequence of SEQ ID NO:908, comprising at least one substitution or one substitution set at one or more positions selected from 21/42/149, 21/42/149/214/253, 21/42/179/214/244/253, 21/42/253/ 260/261, 21/149, 21/149/179, 21/149/179/253, 21/149/179/ 253/260, 21/149/179/253/260/261, 21/149/179/261, 21/149/ 260/261, 21/149/261, 21/179/214/253, 21/179/253, 21/179/ 261, 21/214/253, 21/253, 40, 42/149/179/253/260, 42/149/

179/260/261, 42/149/214/253, 42/179/253/261, 42/253, 104, 111, 149, 149/179, 149/179/253, 149/179/253/260/261, 149/179/260, 149/179/260/261, 149/179/261, 149/253, 149/261, 160, 178, 179/214/253, 179/253, 179/253/260, 179/253/260/261, 179/253/261, 179/260/261, 179/261, 253, 253/260/261, 253/261, and 255, wherein the positions are numbered with reference to SEQ ID NO:908. In some additional embodiments, the engineered polypeptide comprises at least one substitution or one substitution set selected from 21K/42T/149E, 21K/42T/149E/214A/253G, 21K/42T/179R/214A/244F/253G, 21K/42T/253G/260Q/261E, 21K/149E, 21K/149E/179N, 21K/149E/179N/253G, 21K/149E/179N/261E, 21K/149E/179R, 21K/149E/179R/253G/260Q/261E, 21K/149E/179R/253R/260Q, 21K/149E/260Q/261E, 21K/149E/261E, 21K/179N/253G, 21K/179R/214A/253G, 21K/179R/253G, 21K/179R/261E, 21K/214A/253G, 21K/253G, 40T, 42T/149E/179N/260Q/261E, 42T/149E/179R/253G/260Q, 42T/149E/214A/253G, 42T/179N/253G/261E, 42T/253G, 104L, 111L, 149E, 149E/179N/253G, 149E/179N/253G/260Q/261E, 149E/179R, 149E/179R/253G, 149E/179R/260Q, 149E/179R/260Q/261E, 149E/179R/261E, 149E/253G, 149E/253R, 149E/261E, 160S, 178L, 179N/253G, 179N/253G/260Q, 179R/214A/253G, 179R/253G, 179R/253G/260Q, 179R/253G/260Q/261E, 179R/253G/261E, 179R/260Q/261E, 179R/261E, 253G, 253G/260Q/261E, 253G/261E, and 255P, wherein the positions are numbered with reference to SEQ ID NO:908. In some embodiments, the engineered polypeptide comprises at least one substitution or one substitution set selected from R21K/K42T/V149E, R21K/K42T/V149E/P214A/S253G, R21K/K42T/K179R/P214A/L244F/S253G, R21K/K42T/S253G/R260Q/G261E, R21K/V149E, R21K/V149E/K179N, R21K/V149E/K179N/S253G, R21K/V149E/K179N/G261E, R21K/V149E/K179R, R21K/V149E/K179R/S253G/R260Q/G261E, R21K/V149E/K179R/S253R/R260Q, R21K/V149E/R260Q/G261E, R21K/V149E/G261E, R21K/K179N/S253G, R21K/K179R/P214A/S253G, R21K/K179R/S253G, R21K/K179R/G261E, R21K/P214A/S253G, R21K/S253G, S40T, K42T/V149E/K179N/R260Q/G261E, K42T/V149E/K179R/S253G/R260Q, K42T/V149E/P214A/S253G, K42T/K179N/S253G/G261E, K42T/S253G, M104L, K111L, V149E, V149E/K179N/S253G, V149E/K179N/S253G/R260Q/G261E, V149E/K179R, V149E/K179R/S253G, V149E/K179R/R260Q, V149E/K179R/R260Q/G261E, V149E/K179R/G261E, V149E/S253G, V149E/S253R, V149E/G261E, A160S, S178L, K179N/S253G, K179N/S253G/R260Q, K179R/P214A/S253G, K179R/S253G, K179R/S253G/R260Q, K179R/S253G/R260Q/G261E, K179R/S253G/G261E, K179R/R260Q/G261E, K179R/G261E, S253G, S253G/R260Q/G261E, S253G/G261E, and S255P, wherein the positions are numbered with reference to SEQ ID NO:908. In some additional embodiments, the engineered polypeptide comprises an amino acid sequence with at least 80% sequence identity to any even-numbered sequence set forth in SEQ ID NO:956 to SEQ ID NO:1060.

The present invention provides an engineered polypeptide comprising an amino acid sequence with at least 80%, 85%, 90%, 91%, 92%, 93%, 94%, 95%, 96%, 97%, 98%, 99% sequence identity to a reference sequence of SEQ ID NO:956, comprising at least one substitution or one substitution set at one or more positions selected from 3, 21/104/160/178/179, 21/104/160/255/258, 21/104/178/179/255, 21/104/178/255/258, 21/104/255, 21/104/255/258, 21/178/179/255/260, 21/255/260, 31, 32, 40, 40/104/178/179, 40/160/178, 46/82/259, 103, 104/149/255/258/260, 104/149/258, 104/160, 104/160/178, 104/160/178/179/255, 104/160/178/179/260, 104/160/178/255/260, 104/160/179, 104/178/179/255/258, 104/178/255/258/260, 104/178/255/260, 104/179, 104/255/260, 104/258/260, 111/149/255/258, 111/149/255/260, 111/160/178/179/255/258/260, 111/160/255/260, 154, 156, 160, 160/178/179, 174, 194, 197, 205, 205/229, 222, 253, 257, 258/260, and 260, wherein the positions are numbered with reference to SEQ ID NO:956. In some additional embodiments, the engineered polypeptide comprises at least one substitution or one substitution set selected from 3C, 3T, 21K/104L/160S/178L/179R, 21K/104L/160S/255A/258P, 21K/104L/178R/179R/255F, 21K/104L/178R/255F/258P, 21K/104L/255A, 21K/104L/255F/258P, 21K/178R/179R/255A/260Q, 21K/255A/260Q, 31H, 32M, 40K, 40T/104L/178R/179R, 40T/160S/178L, 46I/82Q/259N, 103K, 104L/149E/255F/258P/260Q, 104L/149E/258P, 104L/160S, 104L/160S/178A/255A/260Q, 104L/160S/178K/179R/260Q, 104L/160S/178L, 104L/160S/178R/179R/255A, 104L/160S/179R, 104L/178A/179R/255A/258P, 104L/178K/255F/260Q, 104L/178L/255F/258P/260Q, 104L/179R, 104L/255F/260Q, 104L/258P/260Q, 111E/149E/255F/258P, 111E/149E/255F/260Q, 111I/160S/255F/260Q, 111L/160S/178A/179R/255A/258P/260Q, 154H, 154K, 154Q, 154W, 156A, 156T, 160S, 160S/178L/179R, 174A, 194L, 197K, 205I/229S, 205L, 205M, 205T, 222F, 253Y, 257R, 258P/260Q, and 260Q, wherein the positions are numbered with reference to SEQ ID NO:956. In some embodiments, the engineered polypeptide comprises at least one substitution or one substitution set selected from P3C, P3T, R21K/M104L/A160S/S178L/N179R, R21K/M104L/A160S/S255A/A258P, R21K/M104L/S178R/N179R/S255F, R21K/M104L/S178R/S255F/A258P, R21K/M104L/S255A, R21K/M104L/S255F/A258P, R21K/S178R/N179R/S255A/R260Q, R21K/S255A/R260Q, Q31H, A32M, S40K, S40T/M104L/S178R/N179R, S40T/A160S/S178L, N46I/E82Q/G259N, E103K, M104L/V149E/S255F/A258P/R260Q, M104L/V149E/A258P, M104L/A160S, M104L/A160S/S178A/S255A/R260Q, M104L/A160S/S178K/N179R/R260Q, M104L/A160S/S178L, M104L/A160S/S178R/N179R/S255A, M104L/A160S/N179R, M104L/S178A/N179R/S255A/A258P, M104L/S178K/S255F/R260Q, M104L/S178L/S255F/A258P/R260Q, M104L/N179R, M104L/S255F/R260Q, M104L/A258P/R260Q, K111E/V149E/S255F/A258P, K111E/V149E/S255F/R260Q, K111I/A160S/S255F/R260Q, K111L/A160S/S178A/N179R/S255A/A258P/R260Q, L154H, L154K, L154Q, L154W, V156A, V156T, A160S, A160S/S178L/N179R, L174A, T194L, A197K, Q205I/A229S, Q205L, Q205M, Q205T, E222F, G253Y, E257R, A258P/R260Q, and R260Q, wherein the positions are numbered with reference to SEQ ID NO:956. In some additional embodiments, the engineered polypeptide comprises an amino acid sequence with at least 80% sequence identity to any even-numbered sequence set forth in SEQ ID NO:1062 to SEQ ID NO:1170.

The present invention provides an engineered polypeptide comprising an amino acid sequence with at least 80%, 85%, 90%, 91%, 92%, 93%, 94%, 95%, 96%, 97%, 98%, 99% sequence identity to a reference sequence of SEQ ID NO:1062, comprising at least one substitution or one substitution set at one or more positions selected from 3/31/154/205/257, 3/31/205, 3/154/205, 31/55/154/205, 31/55/205, 31/154/205, 31/154/205/257, 31/205, 31/205/222, 40/55/205, 40/154/205, 40/154/205/257, 40/174/205/229, 40/205/229, 54/205/253, 63, 63/149/154/174/178/253, 63/149/154/174/205/253, 63/149/156/178/205/253, 63/149/205, 63/149/205/229/253, 63/149/205/253, 63/154, 63/154/

178/205/253, 63/154/205, 63/154/205/229, 63/154/205/229/ 253, 63/154/205/253, 63/156, 63/156/205, 63/205, 63/205/ 253, 63/253, 67, 98, 149/154, 149/154/205, 149/156/253, 149/205, 149/205/253, 154, 154/160, 154/160/205, 154/160/ 205/222/257, 154/160/253, 154/174, 154/174/178/205, 154/ 174/205/229, 154/205, 154/205/222, 154/205/222/257, 154/ 205/229, 154/205/253, 154/205/257, 154/229, 154/253, 156/ 205, 156/205/253, 156/229/253, 160, 160/205, 160/205/229, 194, 205, 205/222, 205/229, 205/229/253, 205/253, 208, 226, and 253, wherein the positions are numbered with reference to SEQ ID NO:1062. In some additional embodiments, the engineered polypeptide comprises at least one substitution or one substitution set selected from 3C/31H/ 154K/205M/257R, 3L/154W/205L, 3T/31H/205L, 31H/ 55W/154K/205T, 31H/55W/154Q/205T, 31H/55W/154W/ 205T, 31H/55W/205I, 31H/154Q/205L, 31H/154W/205I, 31H/154W/205I/257R, 31H/154W/205L, 31H/154W/205L/ 257R, 31H/205I/222Q, 31H/205L, 40K/55W/205L, 40T/ 154Q/205T, 40T/154Q/205T/257R, 40T/174A/205I/229S, 40T/205T/229S, 54E/205M/253Y, 63M, 63M/149E/154K/ 174A/178K/253Y, 63M/149E/154W/174A/205T/253Y, 63M/149E/156T/178K/205L/253Y, 63M/149E/205L, 63M/ 149E/205L/229S/253Y, 63M/149E/205L/253Y, 63M/149E/ 205T/253Y, 63M/154H/178K/205I/253Y, 63M/154H/205L/ 229S, 63M/154K/205L, 63M/154K/205T/253Y, 63M/154Q/ 205I/229S/253Y, 63M/154W, 63M/154W/178K/205L/ 253Y, 63M/154W/205M, 63M/154W/205T, 63M/156A, 63M/156A/205T, 63M/205L, 63M/205M, 63M/205M/ 253Y, 63M/205T, 63M/205T/253Y, 63M/253Y, 67S, 98Q, 149E/154S/205L, 149E/154W, 149E/156A/253Y, 149E/ 205M, 149E/205M/253Y, 149E/205T, 149E/205T/253D, 154H, 154H/174A, 154H/205L/253Y, 154H/205T, 154K, 154K/160A, 154K/160A/205L, 154K/160A/205M, 154K/ 160A/253Y, 154K/174A/205L/229S, 154K/205I, 154K/ 205M, 154K/253Y, 154Q/160A/205L/222F/257R, 154Q/ 205I/253Y, 154Q/205L/222R/257R, 154Q/205M/257R, 154W, 154W/174A/178K/205T, 154W/205I, 154W/205I/ 222G, 154W/205I/257R, 154W/205L, 154W/205L/222R, 154W/205M, 154W/205T, 154W/205T/222F/257R, 154W/ 205T/222Y, 154W/205T/229S, 154W/205T/253Y, 154W/ 229S, 154W/253Y, 156A/205M/253Y, 156A/229S/253Y, 156T/205T, 160A, 160A/205L, 160A/205L/229S, 160A/ 205M/229S, 194H, 205L, 205L/222G, 205M, 205T, 205T/ 222Y, 205T/229S, 205T/229S/253Y, 205T/253Y, 208L, 208R, 208T, 226C, and 253Y, wherein the positions are numbered with reference to SEQ ID NO:1062. In some embodiments, the engineered polypeptide comprises at least one substitution or one substitution set selected from P3C/ Q31H/L154K/Q205M/E257R, P3L/L154W/Q205L, P3T/ Q31H/Q205L, Q31H/A55W/L154K/Q205T, Q31H/A55W/ L154Q/Q205T, Q31H/A55W/L154W/Q205T, Q31H/ A55W/Q205I, Q31H/L154Q/Q205L, Q31H/L154W/Q205I, Q31H/L154W/Q205I/E257R, Q31H/L154W/Q205L, Q31H/L154W/Q205L/E257R, Q31H/Q205I/E222Q, Q31H/ Q205L, S40K/A55W/Q205L, S40T/L154Q/Q205T, S40T/ L154Q/Q205T/E257R, S40T/L174A/Q205I/A229S, S40T/ Q205T/A229S, K54E/Q205M/G253Y, Q63M, Q63M/ V149E/L154K/L174A/S178K/G253Y, Q63M/V149E/ L154W/L174A/Q205T/G253Y, Q63M/V149E/V156T/ S178K/Q205L/G253Y, Q63M/V149E/Q205L, Q63M/ V149E/Q205L/A229S/G253Y, Q63M/V149E/Q205L/ G253Y, Q63M/V149E/Q205T/G253Y, Q63M/L154H/ S178K/Q205L/G253Y, Q63M/L154H/Q205L/A229S, Q63M/L154K/Q205L, Q63M/L154K/Q205T/G253Y, Q63M/L154Q/Q205I/A229S/G253Y, Q63M/L154W, Q63M/L154W/S178K/Q205L/G253Y, Q63M/L154W/ Q205M, Q63M/L154W/Q205T, Q63M/V156A, Q63M/ V156A/Q205T, Q63M/Q205L, Q63M/Q205M, Q63M/ Q205M/G253Y, Q63M/Q205T, Q63M/Q205T/G253Y, Q63M/G253Y, T67S, P98Q, V149E/L154S/Q205L, V149E/ L154W, V149E/V156A/G253Y, V149E/Q205M, V149E/ Q205M/G253Y, V149E/Q205T, V149E/Q205T/G253D, L154H, L154H/L174A, L154H/Q205L/G253Y, L154H/ Q205T, L154K, L154K/S160A, L154K/S160A/Q205L, L154K/S160A/Q205M, L154K/S160A/G253Y, L154K/ L174A/Q205L/A229S, L154K/Q205I, L154K/Q205M, L154K/G253Y, L154Q/S160A/Q205L/E222F/E257R, L154Q/Q205I/G253Y, L154Q/Q205L/E222R/E257R, L154Q/Q205M/E257R, L154W, L154W/L174A/S178K/ Q205T, L154W/Q205I, L154W/Q205I/E222G, L154W/ Q205I/E257R, L154W/Q205L, L154W/Q205L/E222R, L154W/Q205M, L154W/Q205T, L154W/Q205T/E222F/ E257R, L154W/Q205T/E222Y, L154W/Q205T/A229S, L154W/Q205T/G253Y, L154W/A229S, L154W/G253Y, V156A/Q205M/G253Y, V156A/A229S/G253Y, V156T/ Q205T, S160A, S160A/Q205L, S160A/Q205L/A229S, S160A/Q205M/A229S, T194H, Q205L, Q205L/E222G, Q205M, Q205T, Q205T/E222Y, Q205T/A229S, Q205T/ A229S/G253Y, Q205T/G253Y, D208L, D208R, D208T, A226C, and G253Y, wherein the positions are numbered with reference to SEQ ID NO:1062. In some additional embodiments, the engineered polypeptide comprises an amino acid sequence with at least 80% sequence identity to any even-numbered sequence set forth in SEQ ID NO: 1172 to SEQ ID NO:1384.

The present invention also provides an engineered polynucleotide encoding at least one engineered polypeptide described in the above paragraphs. In some embodiments, the engineered polynucleotide comprises the odd-numbered sequences set forth in SEQ ID NO:5 to SEQ ID NO:1383.

The present invention further provides vectors comprising at least one engineered polynucleotide described above. In some embodiments, the vectors further comprise at least one control sequence.

The present invention also provides host cells comprising the vectors provided herein. In some embodiments, the host cell produces at least one engineered polypeptide provided herein.

The present invention further provides methods of producing an engineered glucose dehydrogenase polypeptide having imine reductase activity, comprising the steps of culturing the host cell provided herein under conditions such that the engineered polynucleotide is expressed and the engineered polypeptide is produced. In some embodiments, the methods further comprise the step of recovering the engineered polypeptide.

DESCRIPTION OF THE INVENTION

Unless defined otherwise, all technical and scientific terms used herein generally have the same meaning as commonly understood by one of ordinary skill in the art to which this invention pertains. Generally, the nomenclature used herein and the laboratory procedures of cell culture, molecular genetics, microbiology, organic chemistry, analytical chemistry and nucleic acid chemistry described below are those well-known and commonly employed in the art. Such techniques are well-known and described in numerous texts and reference works well known to those of skill in the art. Standard techniques, or modifications thereof, are used for chemical syntheses and chemical analyses. All patents, patent applications, articles and publications mentioned herein, both supra and infra, are hereby expressly incorporated herein by reference.

Although any suitable methods and materials similar or equivalent to those described herein find use in the practice of the present invention, some methods and materials are described herein. It is to be understood that this invention is not limited to the particular methodology, protocols, and reagents described, as these may vary, depending upon the context they are used by those of skill in the art. Accordingly, the terms defined immediately below are more fully described by reference to the invention as a whole.

It is to be understood that both the foregoing general description and the following detailed description are exemplary and explanatory only and are not restrictive of the present invention. The section headings used herein are for organizational purposes only and not to be construed as limiting the subject matter described. Numeric ranges are inclusive of the numbers defining the range. Thus, every numerical range disclosed herein is intended to encompass every narrower numerical range that falls within such broader numerical range, as if such narrower numerical ranges were all expressly written herein. It is also intended that every maximum (or minimum) numerical limitation disclosed herein includes every lower (or higher) numerical limitation, as if such lower (or higher) numerical limitations were expressly written herein.

As used in this specification and the appended claims, the singular forms "a", "an" and "the" include plural referents unless the context clearly indicates otherwise. Thus, for example, reference to "a polypeptide" includes more than one polypeptide. Similarly, "comprise," "comprises," "comprising" "include," "includes," and "including" are interchangeable and not intended to be limiting.

It is to be understood that where descriptions of various embodiments use the term "comprising," those skilled in the art would understand that in some specific instances, an embodiment can be alternatively described using language "consisting essentially of" or "consisting of." It is to be further understood that where descriptions of various embodiments use the term "optional" or "optionally" the subsequently described event or circumstance may or may not occur, and that the description includes instances where the event or circumstance occurs and instances in which it does not. It is to be understood that both the foregoing general description, and the following detailed description are exemplary and explanatory only and are not restrictive of this disclosure. The section headings used herein are for organizational purposes only and not to be construed as limiting the subject matter described.

Abbreviations

The abbreviations used for the genetically encoded amino acids are conventional and are as follows:

| Amino Acid | Three-Letter | One-Letter Abbreviation |
|---|---|---|
| Alanine | Ala | A |
| Arginine | Arg | R |
| Asparagine | Asn | N |
| Aspartate | Asp | D |
| Cysteine | Cys | C |
| Glutamate | Glu | E |
| Glutamine | Gln | Q |
| Glycine | Gly | G |
| Histidine | His | H |
| Isoleucine | Ile | I |
| Leucine | Leu | L |
| Lysine | Lys | K |

-continued

| Amino Acid | Three-Letter | One-Letter Abbreviation |
|---|---|---|
| Methionine | Met | M |
| Phenylalanine | Phe | F |
| Proline | Pro | P |
| Serine | Ser | S |
| Threonine | Thr | T |
| Tryptophan | Trp | W |
| Tyrosine | Tyr | Y |
| Valine | Val | V |

When the three-letter abbreviations are used, unless specifically preceded by an "L" or a "D" or clear from the context in which the abbreviation is used, the amino acid may be in either the L- or D-configuration about α-carbon ($C_\alpha$). For example, whereas "Ala" designates alanine without specifying the configuration about the α-carbon, "D-Ala" and "L-Ala" designate D-alanine and L-alanine, respectively.

When the one-letter abbreviations are used, upper case letters designate amino acids in the L-configuration about the α-carbon and lower case letters designate amino acids in the D-configuration about the α-carbon. For example, "A" designates L-alanine and "a" designates D-alanine. When polypeptide sequences are presented as a string of one-letter or three-letter abbreviations (or mixtures thereof), the sequences are presented in the amino (N) to carboxy (C) direction in accordance with common convention.

The abbreviations used for the genetically encoding nucleosides are conventional and are as follows: adenosine (A); guanosine (G); cytidine (C); thymidine (T); and uridine (U). Unless specifically delineated, the abbreviated nucleotides may be either ribonucleosides or 2'-deoxyribonucleosides. The nucleosides may be specified as being either ribonucleosides or 2'-deoxyribonucleosides on an individual basis or on an aggregate basis. When nucleic acid sequences are presented as a string of one-letter abbreviations, the sequences are presented in the 5' to 3' direction in accordance with common convention, and the phosphates are not indicated.

Definitions

In reference to the present invention, the technical and scientific terms used in the descriptions herein will have the meanings commonly understood by one of ordinary skill in the art, unless specifically defined otherwise. Accordingly, the following terms are intended to have the following meanings.

"EC" number refers to the Enzyme Nomenclature of the Nomenclature Committee of the International Union of Biochemistry and Molecular Biology (NC-IUBMB). The IUBMB biochemical classification is a numerical classification system for enzymes based on the chemical reactions they catalyze.

"ATCC" refers to the American Type Culture Collection whose biorepository collection includes genes and strains.

"NCBI" refers to National Center for Biological Information and the sequence databases provided therein.

"Protein," "polypeptide," and "peptide" are used interchangeably herein to denote a polymer of at least two amino acids covalently linked by an amide bond, regardless of length or post-translational modification (e.g., glycosylation, phosphorylation, lipidation, myristilation, ubiquitination, etc.). Included within this definition are D- and L-amino acids, and mixtures of D- and L-amino acids, as well as polymers comprising D- and L-amino acids, and mixtures of D- and L-amino acids.

"Amino acids" are referred to herein by either their commonly known three-letter symbols or by the one-letter symbols recommended by IUPAC-IUB Biochemical Nomenclature Commission. Nucleotides, likewise, may be referred to by their commonly accepted single letter codes.

As used herein, "polynucleotide" and "nucleic acid" refer to two or more nucleosides that are covalently linked together. The polynucleotide may be wholly comprised of ribonucleotides (i.e., RNA), wholly comprised of 2' deoxyribonucleotides (i.e., DNA), or comprised of mixtures of ribo- and 2' deoxyribonucleotides. While the nucleosides will typically be linked together via standard phosphodiester linkages, the polynucleotides may include one or more non-standard linkages. The polynucleotide may be single-stranded or double-stranded, or may include both single-stranded regions and double-stranded regions. Moreover, while a polynucleotide will typically be composed of the naturally occurring encoding nucleobases (i.e., adenine, guanine, uracil, thymine and cytosine), it may include one or more modified and/or synthetic nucleobases, such as, for example, inosine, xanthine, hypoxanthine, etc. In some embodiments, such modified or synthetic nucleobases are nucleobases encoding amino acid sequences.

As used herein, "imine" refers to an organic compound or functional group that contains a nitrogen-carbon double bond, wherein the nitrogen is bonded to hydrogen or an organic group.

"Imine reductase activity," as used herein, refers to an enzymatic activity in which a carbonyl group of a ketone or aldehyde and an amino group a primary or secondary amine (wherein the carbonyl and amino groups can be on separate compounds or the same compound) are converted to a secondary or tertiary amine product compound, in the presence of cofactor NAD(P)H, as illustrated in Scheme 1.

"Imine reductase" or "IRED," as used herein, refers to an enzyme having imine reductase activity. It is to be understood that imine reductases are not limited to engineered polypeptides derived from the wild-type imine reductases, but may include other enzymes having imine reductase activity, including engineered polypeptides derived from glucose dehydrogenases. Imine reductases, as used herein, include naturally occurring (wild-type) imine reductases as well as non-naturally occurring engineered polypeptides generated by human manipulation.

"Glucose dehydrogenase" or "GDH" refers to the original member of the short chain dehydrogenase reductase family. GDH is well-known for its NAD(P)-dependent oxidation of D-glucose to gluconolactone. While the GDH enzymes of the present invention are derived from *Bacillus subtilis*, the present invention is not thus limited, and GDH enzymes may be derived from any suitable organism or created synthetically. Glucose dehydrogenases, as used herein, include naturally occurring (wild-type) glucose dehydrogenases, as well as non-naturally occurring engineered polypeptides generated by human manipulation.

"Coding sequence" refers to that portion of a nucleic acid (e.g., a gene) that encodes an amino acid sequence of a protein.

"Naturally-occurring" or "wild-type" refers to the form found in nature. For example, a naturally occurring or wild-type polypeptide or polynucleotide sequence is a sequence present in an organism that can be isolated from a source in nature and which has not been intentionally modified by human manipulation.

As used herein, "recombinant," "engineered," and "non-naturally occurring" when used with reference to a cell, nucleic acid, or polypeptide, refer to a material, or a material corresponding to the natural or native form of the material, that has been modified in a manner that would not otherwise exist in nature. In some embodiments, the cell, nucleic acid or polypeptide is identical a naturally occurring cell, nucleic acid or polypeptide, but is produced or derived from synthetic materials and/or by manipulation using recombinant techniques. Non-limiting examples include, among others, recombinant cells expressing genes that are not found within the native (non-recombinant) form of the cell or express native genes that are otherwise expressed at a different level.

"Percentage of sequence identity" and "percentage homology" are used interchangeably herein to refer to comparisons among polynucleotides or polypeptides, and are determined by comparing two optimally aligned sequences over a comparison window, wherein the portion of the polynucleotide or polypeptide sequence in the comparison window may comprise additions or deletions (i.e., gaps) as compared to the reference sequence for optimal alignment of the two sequences. The percentage may be calculated by determining the number of positions at which the identical nucleic acid base or amino acid residue occurs in both sequences to yield the number of matched positions, dividing the number of matched positions by the total number of positions in the window of comparison and multiplying the result by 100 to yield the percentage of sequence identity. Alternatively, the percentage may be calculated by determining the number of positions at which either the identical nucleic acid base or amino acid residue occurs in both sequences or a nucleic acid base or amino acid residue is aligned with a gap to yield the number of matched positions, dividing the number of matched positions by the total number of positions in the window of comparison and multiplying the result by 100 to yield the percentage of sequence identity. Those of skill in the art appreciate that there are many established algorithms available to align two sequences. Optimal alignment of sequences for comparison can be conducted, e.g., by the local homology algorithm of Smith and Waterman (Smith and Waterman, Adv. Appl. Math., 2:482 [1981]), by the homology alignment algorithm of Needleman and Wunsch (Needleman and Wunsch, J. Mol. Biol., 48:443 [1970]), by the search for similarity method of Pearson and Lipman (Pearson and Lipman, Proc. Natl. Acad. Sci. USA 85:2444 [1988]), by computerized implementations of these algorithms (e.g., GAP, BESTFIT, FASTA, and TFASTA in the GCG Wisconsin Software Package), or by visual inspection, as known in the art. Examples of algorithms that are suitable for determining percent sequence identity and sequence similarity include, but are not limited to the BLAST and BLAST 2.0 algorithms, which are described by Altschul et al. (See, Altschul et al., J. Mol. Biol., 215: 403-410 [1990]; and Altschul et al., Nucl. Acids Res., 3389-3402 [1977], respectively). Software for performing BLAST analyses is publicly available through the National Center for Biotechnology Information website. This algorithm involves first identifying high scoring sequence pairs (HSPs) by identifying short words of length W in the query sequence, which either match or satisfy some positive-valued threshold score T when aligned with a word of the same length in a database sequence. T is referred to as, the neighborhood word score threshold (Altschul et al., supra). These initial neighborhood word hits act as seeds for initiating searches to find longer HSPs containing them. The word hits are then extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) of 10, M=5, N=−4, and a comparison of both strands. For amino acid sequences, the BLASTP program uses as defaults a wordlength (W) of 3, an expectation (E) of 10, and the BLOSUM62 scoring matrix (See, Henikoff and Henikoff, Proc. Natl. Acad. Sci. USA 89:10915 [1989]). Exemplary determination of sequence alignment and % sequence identity can employ the BESTFIT or GAP programs in the GCG Wisconsin Software package (Accelrys, Madison WI), using default parameters provided.

"Reference sequence" refers to a defined sequence used as a basis for a sequence comparison. A reference sequence may be a subset of a larger sequence, for example, a segment of a full-length gene or polypeptide sequence. Generally, a reference sequence is at least 20 nucleotide or amino acid residues in length, at least 25 residues in length, at least 50 residues in length, or the full length of the nucleic acid or polypeptide. Since two polynucleotides or polypeptides may each (1) comprise a sequence (i.e., a portion of the complete sequence) that is similar between the two sequences, and (2) may further comprise a sequence that is divergent between the two sequences, sequence comparisons between two (or more) polynucleotides or polypeptide are typically performed by comparing sequences of the two polynucleotides or polypeptides over a "comparison window" to identify and compare local regions of sequence similarity. In some embodiments, a "reference sequence" can be based on a primary amino acid sequence, where the reference sequence is a sequence that can have one or more changes in the primary sequence. For instance, a "reference sequence based on SEQ ID NO:4 having at the residue corresponding to X14 a valine" or X14V refers to a reference sequence in which the corresponding residue at X14 in SEQ ID NO:4, which is a tyrosine, has been changed to valine.

"Comparison window" refers to a conceptual segment of at least about 20 contiguous nucleotide positions or amino acids residues wherein a sequence may be compared to a reference sequence of at least 20 contiguous nucleotides or amino acids and wherein the portion of the sequence in the comparison window may comprise additions or deletions (i.e., gaps) of 20 percent or less as compared to the reference sequence (which does not comprise additions or deletions) for optimal alignment of the two sequences. The comparison window can be longer than 20 contiguous residues, and includes, optionally 30, 40, 50, 100, or longer windows.

As used herein, "substantial identity" refers to a polynucleotide or polypeptide sequence that has at least 80 percent sequence identity, at least 85 percent identity, at least between 89 to 95 percent sequence identity, or more usually, at least 99 percent sequence identity as compared to a reference sequence over a comparison window of at least 20 residue positions, frequently over a window of at least 30-50 residues, wherein the percentage of sequence identity is calculated by comparing the reference sequence to a sequence that includes deletions or additions which total 20 percent or less of the reference sequence over the window of comparison. In some specific embodiments applied to polypeptides, the term "substantial identity" means that two polypeptide sequences, when optimally aligned, such as by the programs GAP or BESTFIT using default gap weights, share at least 80 percent sequence identity, preferably at least 89 percent sequence identity, at least 95 percent sequence identity or more (e.g., 99 percent sequence identity). In some embodiments, residue positions that are not identical in sequences being compared differ by conservative amino acid substitutions.

"Corresponding to," "reference to," and "relative to" when used in the context of the numbering of a given amino acid or polynucleotide sequence refer to the numbering of the residues of a specified reference sequence when the given amino acid or polynucleotide sequence is compared to the reference sequence. In other words, the residue number or residue position of a given polymer is designated with respect to the reference sequence rather than by the actual numerical position of the residue within the given amino acid or polynucleotide sequence. For example, a given amino acid sequence, such as that of an engineered glucose dehydrogenase, can be aligned to a reference sequence by introducing gaps to optimize residue matches between the two sequences. In these cases, although the gaps are present, the numbering of the residue in the given amino acid or polynucleotide sequence is made with respect to the reference sequence to which it has been aligned.

"Amino acid difference" or "residue difference" refers to a change in the amino acid residue at a position of a polypeptide sequence relative to the amino acid residue at a corresponding position in a reference sequence. The positions of amino acid differences generally are referred to herein as "Xn," where n refers to the corresponding position in the reference sequence upon which the residue difference is based. For example, a "residue difference at position X25 as compared to SEQ ID NO: 2" refers to a change of the amino acid residue at the polypeptide position corresponding to position 25 of SEQ ID NO:2. Thus, if the reference polypeptide of SEQ ID NO: 2 has a valine at position 25, then a "residue difference at position X25 as compared to SEQ ID NO:2" an amino acid substitution of any residue other than valine at the position of the polypeptide corresponding to position 25 of SEQ ID NO: 2. In most instances herein, the specific amino acid residue difference at a position is indicated as "XnY" where "Xn" specified the corresponding position as described above, and "Y" is the single letter identifier of the amino acid found in the engineered polypeptide (i.e., the different residue than in the reference polypeptide). In some embodiments, more than one amino acid can appear in a specified residue position (i.e., the alternative amino acids can be listed in the form XnY/Z, where Y and Z represent alternate amino acid residues). In some instances (e.g., in Tables 5.1, 6.1, 7.1, 8.1, 9.1, 10.1, 11.1 and 12.1) the present invention also provides specific amino acid differences denoted by the conventional notation "AnB", where A is the single letter identifier of the residue in the reference sequence, "n" is the number of the residue position in the reference sequence, and B is the single letter identifier of the residue substitution in the sequence of the engineered polypeptide. Furthermore, in some instances, a polypeptide of the present invention can include one or more amino acid residue differences relative to a reference sequence, which is indicated by a list of the specified positions where changes are made relative to the reference sequence. In some additional embodiments, the present invention provides engineered polypeptide sequences comprising both conservative and non-conservative amino acid substitutions.

As used herein, "conservative amino acid substitution" refers to a substitution of a residue with a different residue having a similar side chain, and thus typically involves substitution of the amino acid in the polypeptide with amino acids within the same or similar defined class of amino acids. By way of example and not limitation, an amino acid with an aliphatic side chain is substituted with another aliphatic amino acid (e.g., alanine, valine, leucine, and isoleucine); an amino acid with an hydroxyl side chain is substituted with another amino acid with a hydroxyl side chain (e.g., serine and threonine); an amino acid having aromatic side chains is substituted with another amino acid having an aromatic side chain (e.g., phenylalanine, tyrosine, tryptophan, and histidine); an amino acid with a basic side chain is substituted with another amino acid with a basis side chain (e.g., lysine and arginine); an amino acid with an acidic side chain is substituted with another amino acid with an acidic side chain (e.g., aspartic acid or glutamic acid); and/or a hydrophobic or hydrophilic amino acid is replaced with another hydrophobic or hydrophilic amino acid, respectively. Exemplary conservative substitutions are provided in Table 1 below.

TABLE 1

Conservative Amino Acid Substitution Examples

| Residue | Possible Conservative Substitutions |
|---|---|
| A, L, V, I | Other aliphatic (A, L, V, I) |
|  | Other non-polar (A, L, V, I, G, M) |
| G, M | Other non-polar (A, L, V, I, G, M) |
| D, E | Other acidic (D, E) |
| K, R | Other basic (K, R) |
| N, Q, S, T | Other polar |
| H, Y, W, F | Other aromatic (H, Y, W, F) |
| C, P | None |

"Non-conservative substitution" refers to substitution of an amino acid in the polypeptide with an amino acid with significantly differing side chain properties. Non-conservative substitutions may use amino acids between, rather than within, the defined groups and affects (a) the structure of the peptide backbone in the area of the substitution (e.g., proline for glycine), (b) the charge or hydrophobicity, or (c) the bulk of the side chain. By way of example and not limitation, an exemplary non-conservative substitution can be an acidic amino acid substituted with a basic or aliphatic amino acid; an aromatic amino acid substituted with a small amino acid; and a hydrophilic amino acid substituted with a hydrophobic amino acid.

"Deletion" refers to modification to the polypeptide by removal of one or more amino acids from the reference polypeptide. Deletions can comprise removal of 1 or more amino acids, 2 or more amino acids, 5 or more amino acids, 10 or more amino acids, 15 or more amino acids, or 20 or more amino acids, up to 10% of the total number of amino acids, or up to 20% of the total number of amino acids making up the reference enzyme while retaining enzymatic activity and/or retaining the improved properties of an engineered glucose dehydrogenase enzyme. Deletions can be directed to the internal portions and/or terminal portions of the polypeptide. In various embodiments, the deletion can comprise a continuous segment or can be discontinuous.

"Insertion" refers to modification to the polypeptide by addition of one or more amino acids from the reference polypeptide. In some embodiments, the improved engineered glucose dehydrogenase enzymes comprise insertions of one or more amino acids to the naturally occurring polypeptide having imine reductase activity as well as insertions of one or more amino acids to other improved glucose dehydrogenase polypeptides. Insertions can be in the internal portions of the polypeptide, or to the carboxy or amino terminus. Insertions as used herein include fusion proteins as is known in the art. The insertion can be a contiguous segment of amino acids or separated by one or more of the amino acids in the naturally occurring polypeptide.

"Fragment" as used herein refers to a polypeptide that has an amino-terminal and/or carboxy-terminal deletion, but where the remaining amino acid sequence is identical to the corresponding positions in the sequence. Fragments can be at least 14 amino acids long, at least 20 amino acids long, at least 50 amino acids long or longer, and up to 70%, 80%, 90%, 95%, 98%, and 99% of the full-length glucose dehydrogenase polypeptide, for example the polypeptide of SEQ ID NO:4 or engineered glucose dehydrogenase provided in the even-numbered sequences of SEQ ID NO:6-1384.

"Isolated polypeptide" refers to a polypeptide which is substantially separated from other contaminants that naturally accompany it, e.g., protein, lipids, and polynucleotides. The term embraces polypeptides which have been removed or purified from their naturally-occurring environment or expression system (e.g., host cell or in vitro synthesis). The engineered glucose dehydrogenase enzymes may be present within a cell, present in the cellular medium, or prepared in various forms, such as lysates or isolated preparations. As such, in some embodiments, the engineered glucose dehydrogenase enzyme can be an isolated polypeptide.

"Substantially pure polypeptide" refers to a composition in which the polypeptide species is the predominant species present (i.e., on a molar or weight basis it is more abundant than any other individual macromolecular species in the composition), and is generally a substantially purified composition when the object species comprises at least about 50 percent of the macromolecular species present by mole or % weight. Generally, a substantially pure glucose dehydrogenase composition will comprise about 60% or more, about 70% or more, about 80% or more, about 90% or more, about 95% or more, and about 98% or more of all macromolecular species by mole or % weight present in the composition. In some embodiments, the object species is purified to essential homogeneity (i.e., contaminant species cannot be detected in the composition by conventional detection methods) wherein the composition consists essentially of a single macromolecular species. Solvent species, small molecules (<500 Daltons), and elemental ion species are not considered macromolecular species. In some embodiments, the isolated engineered glucose dehydrogenase polypeptide is a substantially pure polypeptide composition.

"Stereoselective" refers to a preference for formation of one stereoisomer over another in a chemical or enzymatic reaction. Stereoselectivity can be partial, where the formation of one stereoisomer is favored over the other, or it may be complete where only one stereoisomer is formed. When the stereoisomers are enantiomers, the stereoselectivity is referred to as enantioselectivity, the fraction (typically reported as a percentage) of one enantiomer in the sum of both. It is commonly alternatively reported in the art (typically as a percentage) as the enantiomeric excess (e.e.) calculated therefrom according to the formula [major enantiomer—minor enantiomer]/[major enantiomer+minor enantiomer]. Where the stereoisomers are diastereoisomers, the stereoselectivity is referred to as diastereoselectivity, the fraction (typically reported as a percentage) of one diastereomer in a mixture of two diastereomers, commonly alternatively reported as the diastereomeric excess (d.e.). Enantiomeric excess and diastereomeric excess are types of stereomeric excess.

"Highly stereoselective" refers to a chemical or enzymatic reaction that is capable of converting a substrate or substrates (e.g., substrate compounds (2) and (3)), to the corresponding amine product (e.g., Compound (1)), with at least about 85% stereomeric excess.

As used herein, "improved enzyme property" refers to at least one improved property of an enzyme. In some embodiments, the present invention provides engineered glucose dehydrogenase polypeptides that exhibit an improvement in any enzyme property as compared to a reference glucose dehydrogenase polypeptide and/or a wild-type glucose dehydrogenase polypeptide, and/or another engineered glucose dehydrogenase polypeptide. For the engineered glucose dehydrogenase polypeptides described herein, the comparison is generally made to the wild-type enzyme from which the glucose dehydrogenase is derived, although in some embodiments, the reference enzyme can be another improved engineered glucose dehydrogenase. Thus, the level of "improvement" can be determined and compared between various glucose dehydrogenase polypeptides, including wild-type, as well as engineered glucose dehydrogenases. Improved properties include, but are not limited, to such properties as enzymatic activity (which can be expressed in terms of percent conversion of the substrate), thermo stability, solvent stability, pH activity profile, cofactor requirements, refractoriness to inhibitors (e.g., substrate or product inhibition), stereospecificity, and/or stereoselectivity (including enantioselectivity).

"Increased enzymatic activity" refers to an improved property of the engineered glucose dehydrogenase polypeptides, which can be represented by an increase in specific activity (e.g., product produced/time/weight protein) or an increase in percent conversion of the substrate to the product (e.g., percent conversion of starting amount of substrate to product in a specified time period using a specified amount of glucose dehydrogenase) as compared to the reference glucose dehydrogenase enzyme. Exemplary methods to determine enzyme activity are provided in the Examples. Any property relating to enzyme activity may be affected, including the classical enzyme properties of $K_m$, $V_{max}$ or $k_{cat}$, changes of which can lead to increased enzymatic activity. Improvements in enzyme activity can be from about 1.2 times the enzymatic activity of the corresponding wild-type enzyme, to as much as 2 times, 5 times, 10 times, 20 times, 25 times, 50 times or more enzymatic activity than the naturally occurring or another engineered glucose dehydrogenase from which the glucose dehydrogenase polypeptides were derived. Glucose dehydrogenase activity can be measured by any one of standard assays, such as by monitoring changes in properties of substrates, cofactors, or products. In some embodiments, the amount of products generated can be measured by Liquid Chromatography-Mass Spectrometry (LC-MS). Comparisons of enzyme activities are made using a defined preparation of enzyme, a defined assay under a set condition, and one or more defined substrates, as further described in detail herein. Generally, when lysates are compared, the numbers of cells and the amount of protein assayed are determined as well as use of identical expression systems and identical host cells to minimize variations in amount of enzyme produced by the host cells and present in the lysates.

"Conversion" refers to the enzymatic conversion of the substrate(s) to the corresponding product(s). "Percent conversion" refers to the percent of the substrate that is converted to the product within a period of time under specified conditions. Thus, the "enzymatic activity" or "activity" of a glucose dehydrogenase polypeptide can be expressed as "percent conversion" of the substrate to the product.

"Thermostable" refers to a glucose dehydrogenase polypeptide that maintains similar activity (more than 60% to 80% for example) after exposure to elevated temperatures (e.g., 40-80° C.) for a period of time (e.g., 0.5-24 hrs) compared to the wild-type enzyme exposed to the same elevated temperature.

"Solvent stable" refers to an glucose dehydrogenase polypeptide that maintains similar activity (more than e.g., 60% to 80%) after exposure to varying concentrations (e.g., 5-99%) of solvent (ethanol, isopropyl alcohol, dimethylsulfoxide (DMSO), tetrahydrofuran, 2-methyltetrahydrofuran, acetone, toluene, butyl acetate, methyl tert-butyl ether, etc.) for a period of time (e.g., 0.5-24 hrs) compared to the wild-type enzyme exposed to the same concentration of the same solvent.

"Thermo- and solvent stable" refers to a glucose dehydrogenase polypeptide that is both thermostable and solvent stable.

The term "stringent hybridization conditions" is used herein to refer to conditions under which nucleic acid hybrids are stable. As known to those of skill in the art, the stability of hybrids is reflected in the melting temperature (Tm) of the hybrids. In general, the stability of a hybrid is a function of ion strength, temperature, G/C content, and the presence of chaotropic agents. The $T_m$ values for polynucleotides can be calculated using known methods for predicting melting temperatures (See e.g., Baldino et al., Meth. Enzymol., 168:761-777 [1989]; Bolton et al., Proc. Natl. Acad. Sci. USA 48:1390 [1962]; Bresslauer et al., Proc. Natl. Acad. Sci. USA 83:8893-8897 [1986]; Freier et al., Proc. Natl. Acad. Sci. USA 83:9373-9377 [1986]; Kierzek et al., Biochem., 25:7840-7846 [1986]; Rychlik et al., 1990, Nucl. Acids Res., 18:6409-6412 [1990] (erratum, Nucl. Acids Res., 19:698 [1991]); Sambrook et al., supra); Suggs et al., 1981, in *Developmental Biology Using Purified Genes*, Brown et al. [eds.], pp. 683-693, Academic Press, Cambridge, MA [1981]; and Wetmur, Crit. Rev. Biochem. Mol. Biol., 26:227-259 [1991]). In some embodiments, the polynucleotide encodes the polypeptide disclosed herein and hybridizes under defined conditions, such as moderately stringent or highly stringent conditions, to the complement of a sequence encoding an engineered glucose dehydrogenase enzyme of the present invention.

"Hybridization stringency" relates to hybridization conditions, such as washing conditions, in the hybridization of nucleic acids. Generally, hybridization reactions are performed under conditions of lower stringency, followed by washes of varying but higher stringency. The term "moderately stringent hybridization" refers to conditions that permit target-DNA to bind a complementary nucleic acid that has about 60% identity, preferably about 75% identity, about 85% identity to the target DNA, with greater than about 90% identity to target-polynucleotide. Exemplary moderately stringent conditions are conditions equivalent to hybridization in 50% formamide, 5× Denhart's solution, 5×SSPE, 0.2% SDS at 42° C., followed by washing in 0.2×SSPE, 0.2% SDS, at 42° C. "High stringency hybridization" refers generally to conditions that are about 10° C. or less from the thermal melting temperature $T_m$ as determined under the solution condition for a defined polynucleotide sequence. In some embodiments, a high stringency condition refers to conditions that permit hybridization of only those nucleic acid sequences that form stable hybrids in 0.018M NaCl at 65° C. (i.e., if a hybrid is not stable in 0.018M NaCl at 65° C., it will not be stable under high stringency conditions, as contemplated herein). High stringency conditions can be provided, for example, by hybridization in conditions equivalent to 50% formamide, 5× Denhart's solution, 5×SSPE, 0.2% SDS at 42° C., followed by washing in 0.1×SSPE, and 0.1% SDS at 65° C. Another high stringency condition is hybridizing in conditions equivalent to hybridizing in 5×SSC containing 0.1% (w:v) SDS at 65° C. and washing in 0.1×SSC containing 0.1% SDS at 65° C. Other high stringency hybridization conditions, as well as moderately stringent conditions, are described in the references cited above.

"Heterologous" polynucleotide refers to any polynucleotide that is introduced into a host cell by laboratory techniques, and includes polynucleotides that are removed from a host cell, subjected to laboratory manipulation, and then reintroduced into a host cell.

"Codon optimized" refers to changes in the codons of the polynucleotide encoding a protein to those preferentially used in a particular organism such that the encoded protein is efficiently expressed in the organism of interest. Although the genetic code is degenerate in that most amino acids are represented by several codons, called "synonyms" or "synonymous" codons, it is well known that codon usage by particular organisms is nonrandom and biased towards particular codon triplets. This codon usage bias may be higher in reference to a given gene, genes of common function or ancestral origin, highly expressed proteins versus low copy number proteins, and the aggregate protein coding regions of an organism's genome. In some embodiments, the polynucleotides encoding the glucose dehydrogenase enzymes may be codon optimized for optimal production from the host organism selected for expression.

As used herein, "preferred, optimal, high codon usage bias codons" refers interchangeably to codons that are used at higher frequency in the protein coding regions than other codons that code for the same amino acid. The preferred codons may be determined in relation to codon usage in a single gene, a set of genes of common function or origin, highly expressed genes, the codon frequency in the aggregate protein coding regions of the whole organism, codon frequency in the aggregate protein coding regions of related organisms, or combinations thereof. Codons whose frequency increases with the level of gene expression are typically optimal codons for expression. A variety of methods are known for determining the codon frequency (e.g., codon usage, relative synonymous codon usage) and codon preference in specific organisms, including multivariate analysis, for example, using cluster analysis or correspondence analysis, and the effective number of codons used in a gene (See e.g., GCG CodonPreference, Genetics Computer Group Wisconsin Package; CodonW, Peden, University of Nottingham; McInerney, Bioinform., 14:372-73 [1998]; Stenico et al., Nucl. Acids Res., 222437-46 [1994]; Wright, Gene 87:23-29 [1990]). Codon usage tables are available for many different organisms (See e.g., Wada et al., Nucl. Acids Res., 20:2111-2118 [1992]; Nakamura et al., Nucl. Acids Res., 28:292 [2000]; Duret, et al., supra; Henaut and Danchin, in *Escherichia coli and Salmonella*, Neidhardt, et al. (eds.), ASM Press, Washington D.C., p. 2047-2066 [1996]). The data source for obtaining codon usage may rely on any available nucleotide sequence capable of coding for a protein. These data sets include nucleic acid sequences actually known to encode expressed proteins (e.g., complete protein coding sequences-CDS), expressed sequence tags (ESTS), or predicted coding regions of genomic sequences (See e.g., Mount, *Bioinformatics: Sequence and Genome Analysis*, Chapter 8, Cold Spring Harbor Laboratory Press, Cold Spring Harbor, N.Y. [2001]; Uberbacher, Meth. Enzymol., 266:259-281 [1996]; and Tiwari et al., Comput. Appl. Biosci., 13:263-270 [1997]).

"Control sequence" is defined herein to include all components, which are necessary or advantageous for the expression of a polynucleotide and/or polypeptide of the present invention. Each control sequence may be native or foreign to the nucleic acid sequence encoding the polypeptide. Such control sequences include, but are not limited to, a leader, polyadenylation sequence, propeptide sequence, promoter, signal peptide sequence, and transcription terminator. At a minimum, the control sequences include a promoter, and transcriptional and translational stop signals. The control sequences may be provided with linkers for the purpose of introducing specific restriction sites facilitating ligation of the control sequences with the coding region of the nucleic acid sequence encoding a polypeptide.

"Operably linked" is defined herein as a configuration in which a control sequence is appropriately placed (i.e., in a functional relationship) at a position relative to a polynucleotide of interest such that the control sequence directs or regulates the expression of the polynucleotide and/or polypeptide of interest.

"Promoter sequence" refers to a nucleic acid sequence that is recognized by a host cell for expression of a polynucleotide of interest, such as a coding sequence. The promoter sequence contains transcriptional control sequences, which mediate the expression of a polynucleotide of interest. The promoter may be any nucleic acid sequence which shows transcriptional activity in the host cell of choice including mutant, truncated, and hybrid promoters, and may be obtained from genes encoding extracellular or intracellular polypeptides either homologous or heterologous to the host cell.

"Suitable reaction conditions" refer to those conditions in the biocatalytic reaction solution (e.g., ranges of enzyme loading, substrate loading, cofactor loading, temperature, pH, buffers, co-solvents, etc.) under which an imine reductase polypeptide of the present invention is capable of converting one or more substrate compounds to a product compound (e.g., conversion of Compound (2) and Compound (3) to Compound (1). Exemplary "suitable reaction conditions" are provided in the present invention and illustrated by the Examples.

"Composition" refers to a mixture or combination of one or more substances, wherein each substance or component of the composition retains its individual properties. As used herein, a biocatalytic composition refers to a combination of one or more substances useful for biocatalysis.

"Cofactor regeneration system" or "cofactor recycling system" refers to a set of reactants that participate in a reaction that reduces the oxidized form of the cofactor (e.g., $NADP^+$ to NADPH). Cofactors oxidized by the imine reductase catalyzed reductive amination of the ketone substrate are regenerated in reduced form by the cofactor regeneration system. Cofactor regeneration systems comprise a stoichiometric reductant that is a source of reducing hydrogen equivalents and is capable of reducing the oxidized form of the cofactor. The cofactor regeneration system may further comprise a catalyst, for example an enzyme catalyst that catalyzes the reduction of the oxidized form of the cofactor by the reductant. Cofactor regeneration systems to regenerate NADH or NADPH from $NAD^+$ or $NADP^+$, respectively, are known in the art and may be used in the methods described herein.

"Phosphate dehydrogenase" and "PDH" are used interchangeably herein to refer to an $NAD^+$ or $NADP^+$-dependent enzyme that catalyzes the conversion of phosphite and $NAD^+$ or $NADP^+$ to carbon dioxide and NADH or NADPH, respectively.

"Loading", such as in "compound loading" or "enzyme loading" or "cofactor loading" refers to the concentration or amount of a component in a reaction mixture at the start of the reaction.

"Substrate" in the context of a biocatalyst mediated process refers to the compound or molecule acted on by the biocatalyst. For example, a glucose dehydrogenase biocatalyst used in the reductive amination processes disclosed herein there is a ketone (or aldehyde) substrate of Formula (V), and an amine substrate of Formula (VI).

"Product" in the context of a biocatalyst mediated process refers to the compound or molecule resulting from the action of the biocatalyst. For example, an exemplary product for a glucose dehydrogenase biocatalyst used in a process disclosed herein is a secondary or tertiary amine compound, such as a compound of Formula (IV).

"Alkyl" refers to saturated hydrocarbon groups of from 1 to 18 carbon atoms inclusively, either straight chained or branched, more preferably from 1 to 8 carbon atoms inclusively, and most preferably 1 to 6 carbon atoms inclusively. An alkyl with a specified number of carbon atoms is denoted in parenthesis (e.g., $(C_1-C_6)$alkyl refers to an alkyl of 1 to 6 carbon atoms).

"Alkenyl" refers to hydrocarbon groups of from 2 to 12 carbon atoms inclusively, either straight or branched containing at least one double bond but optionally containing more than one double bond.

"Alkynyl" refers to hydrocarbon groups of from 2 to 12 carbon atoms inclusively, either straight or branched containing at least one triple bond but optionally containing more than one triple bond, and additionally optionally containing one or more double bonded moieties.

"Alkylene" refers to a straight or branched chain divalent hydrocarbon radical having from 1 to 18 carbon atoms inclusively, more preferably from 1 to 8 carbon atoms inclusively, and most preferably 1 to 6 carbon atoms inclusively, optionally substituted with one or more suitable substituents. Exemplary "alkylenes" include, but are not limited to, methylene, ethylene, propylene, butylene, and the like.

"Alkenylene" refers to a straight or branched chain divalent hydrocarbon radical having 2 to 12 carbon atoms inclusively and one or more carbon-carbon double bonds, more preferably from 2 to 8 carbon atoms inclusively, and most preferably 2 to 6 carbon atoms inclusively, optionally substituted with one or more suitable substituents.

"Heteroalkyl, "heteroalkenyl," and heteroalkynyl," refer respectively, to alkyl, alkenyl and alkynyl as defined herein in which one or more of the carbon atoms are each independently replaced with the same or different heteroatoms or heteroatomic groups. Heteroatoms and/or heteroatomic groups which can replace the carbon atoms include, but are not limited to, —O—, —S—, —S—O—, —NR—, —PH—, —S(O)—, —S(O)$_2$—, —S(O)NR$^\gamma$—, —S(O)$_2$NR$^\gamma$—, and the like, including combinations thereof, where each Rr is independently selected from hydrogen, alkyl, cycloalkyl, heterocycloalkyl, aryl, and heteroaryl.

"Aryl" refers to an unsaturated aromatic carbocyclic group of from 6 to 12 carbon atoms inclusively having a single ring (e.g., phenyl) or multiple condensed rings (e.g., naphthyl or anthryl). Exemplary aryls include phenyl, pyridyl, naphthyl and the like.

"Arylalkyl" refers to an alkyl substituted with an aryl (i.e., aryl-alkyl- groups), preferably having from 1 to 6 carbon atoms inclusively in the alkyl moiety and from 6 to 12 carbon atoms inclusively in the aryl moiety. Such arylalkyl groups are exemplified by benzyl, phenethyl and the like.

"Aryloxy" refers to —OR$^\lambda$ groups, where R$^\lambda$ is an aryl group, which can be optionally substituted.

"Cycloalkyl" refers to cyclic alkyl groups of from 3 to 12 carbon atoms inclusively having a single cyclic ring or multiple condensed rings which can be optionally substituted with from 1 to 3 alkyl groups. Exemplary cycloalkyl groups include, but are not limited to, single ring structures such as cyclopropyl, cyclobutyl, cyclopentyl, cyclooctyl, 1-methylcyclopropyl, 2-methylcyclopentyl, 2-methylcyclooctyl, and the like, or multiple ring structures, including bridged ring systems, such as adamantyl, and the like.

"Cycloalkylalkyl" refers to an alkyl substituted with a cycloalkyl (i.e., cycloalkyl-alkyl- groups), preferably having from 1 to 6 carbon atoms inclusively in the alkyl moiety and from 3 to 12 carbon atoms inclusively in the cycloalkyl moiety. Such cycloalkylalkyl groups are exemplified by cyclopropylmethyl, cyclohexylethyl and the like.

"Amino" refers to the group —$NH_2$. Substituted amino refers to the group —NHR$^\eta$, NR$^\eta$R$^\eta$, and NR$^\eta$R$^\eta$R$^\eta$, where each R$^q$ is independently selected from substituted or unsubstituted alkyl, cycloalkyl, cycloheteroalkyl, alkoxy, aryl, heteroaryl, heteroarylalkyl, acyl, alkoxycarbonyl, sulfanyl, sulfinyl, sulfonyl, and the like. Typical amino groups include, but are limited to, dimethylamino, diethylamino, trimethylammonium, triethylammonium, methylsulfonylamino, furanyl-oxy-sulfamino, and the like.

"Aminoalkyl" refers to an alkyl group in which one or more of the hydrogen atoms are replaced with one or more amino groups, including substituted amino groups.

"Aminocarbonyl" refers to —C(O)$NH_2$. Substituted aminocarbonyl refers to —C(O)NR$^\eta$R$^\eta$, where the amino group NR$^\eta$R$^\eta$ is as defined herein.

"Oxy" refers to a divalent group —O—, which may have various substituents to form different oxy groups, including ethers and esters.

"Alkoxy" or "alkyloxy" are used interchangeably herein to refer to the group —OR, wherein R is an alkyl group, including optionally substituted alkyl groups.

"Carboxy" refers to —COOH.

"Carbonyl" refers to —C(O)—, which may have a variety of substituents to form different carbonyl groups including acids, acid halides, aldehydes, amides, esters, and ketones.

"Carboxyalkyl" refers to an alkyl in which one or more of the hydrogen atoms are replaced with one or more carboxy groups.

"Aminocarbonylalkyl" refers to an alkyl substituted with an aminocarbonyl group, as defined herein.

"Halogen" or "halo" refers to fluoro, chloro, bromo and iodo.

"Haloalkyl" refers to an alkyl group in which one or more of the hydrogen atoms are replaced with a halogen. Thus, the term "haloalkyl" is meant to include monohaloalkyls, dihaloalkyls, trihaloalkyls, etc. up to perhaloalkyls. For example, the expression "$(C_1-C_2)$ haloalkyl" includes 1-fluoromethyl, difluoromethyl, trifluoromethyl, 1-fluoroethyl, 1,1-difluoroethyl, 1,2-difluoroethyl, 1,1,1 trifluoroethyl, perfluoroethyl, etc.

"Hydroxy" refers to —OH.

"Hydroxyalkyl" refers to an alkyl group in which in which one or more of the hydrogen atoms are replaced with one or more hydroxy groups.

"Thiol" or "sulfanyl" refers to —SH. Substituted thiol or sulfanyl refers to —S—$R^\eta$, where $R^\eta$ is an alkyl, aryl or other suitable substituent.

"Alkylthio" refers to —$SR^\xi$, where $R^\xi$ is an alkyl, which can be optionally substituted. Typical alkylthio group include, but are not limited to, methylthio, ethylthio, n-propylthio, and the like.

"Alkylthioalkyl" refers to an alkyl substituted with an alkylthio group, —$SR^\xi$, where $R^\xi$ is an alkyl, which can be optionally substituted.

"Sulfonyl" refers to —$SO_2$—. Substituted sulfonyl refers to —$SO_2$—$R^\eta$, where $R^\eta$ is an alkyl, aryl or other suitable substituent.

"Alkylsulfonyl" refers to —$SO_2$—$R^\xi$, where $R^\xi$ is an alkyl, which can be optionally substituted. Typical alkylsulfonyl groups include, but are not limited to, methylsulfonyl, ethylsulfonyl, n-propylsulfonyl, and the like.

"Alkylsulfonylalkyl" refers to an alkyl substituted with an alkylsulfonyl group, —$SO_2$—$R^\xi$, where $R^\xi$ is an alkyl, which can be optionally substituted.

"Heteroaryl" refers to an aromatic heterocyclic group of from 1 to 10 carbon atoms inclusively and 1 to 4 heteroatoms inclusively selected from oxygen, nitrogen and sulfur within the ring. Such heteroaryl groups can have a single ring (e.g., pyridyl or furyl) or multiple condensed rings (e.g., indolizinyl or benzothienyl).

"Heteroarylalkyl" refers to an alkyl substituted with a heteroaryl (i.e., heteroaryl-alkyl- groups), preferably having from 1 to 6 carbon atoms inclusively in the alkyl moiety and from 5 to 12 ring atoms inclusively in the heteroaryl moiety. Such heteroarylalkyl groups are exemplified by pyridylmethyl and the like.

"Heterocycle", "heterocyclic" and interchangeably "heterocycloalkyl" refer to a saturated or unsaturated group having a single ring or multiple condensed rings, from 2 to 10 carbon ring atoms inclusively and from 1 to 4 hetero ring atoms inclusively selected from nitrogen, sulfur or oxygen within the ring. Such heterocyclic groups can have a single ring (e.g., piperidinyl or tetrahydrofuryl) or multiple condensed rings (e.g., indolinyl, dihydrobenzofuran or quinuclidinyl). Examples of heterocycles include, but are not limited to, furan, thiophene, thiazole, oxazole, pyrrole, imidazole, pyrazole, pyridine, pyrazine, pyrimidine, pyridazine, indolizine, isoindole, indole, indazole, purine, quinolizine, isoquinoline, quinoline, phthalazine, naphthylpyridine, quinoxaline, quinazoline, cinnoline, pteridine, carbazole, carboline, phenanthridine, acridine, phenanthroline, isothiazole, phenazine, isoxazole, phenoxazine, phenothiazine, imidazolidine, imidazoline, piperidine, piperazine, pyrrolidine, indoline and the like.

"Heterocycloalkylalkyl" refers to an alkyl substituted with a heterocycloalkyl (i.e., heterocycloalkyl-alkyl-groups), preferably having from 1 to 6 carbon atoms inclusively in the alkyl moiety and from 3 to 12 ring atoms inclusively in the heterocycloalkyl moiety.

"Membered ring" is meant to embrace any cyclic structure. The number preceding the term "membered" denotes the number of skeletal atoms that constitute the ring. Thus, for example, cyclohexyl, pyridine, pyran and thiopyran are 6-membered rings and cyclopentyl, pyrrole, furan, and thiophene are 5-membered rings.

"Fused bicyclic ring" as used herein refers to both unsubstituted and substituted carbocyclic and/or heterocyclic ring moieties having 5 to 8 atoms in each ring, the rings having 2 common atoms.

"Optionally substituted" as used herein with respect to the foregoing chemical groups means that positions of the chemical group occupied by hydrogen can be substituted with another atom (unless otherwise specified) exemplified by, but not limited to carbon, oxygen, nitrogen, or sulfur, or a chemical group, exemplified by, but not limited to, hydroxy, oxo, nitro, methoxy, ethoxy, alkoxy, substituted alkoxy, trifluoromethoxy, haloalkoxy, fluoro, chloro, bromo, iodo, halo, methyl, ethyl, propyl, butyl, alkyl, alkenyl, alkynyl, substituted alkyl, trifluoromethyl, haloalkyl, hydroxyalkyl, alkoxyalkyl, thio, alkylthio, acyl, carboxy, alkoxycarbonyl, carboxamido, substituted carboxamido, alkylsulfonyl, alkylsulfinyl, alkylsulfonylamino, sulfonamido, substituted sulfonamido, cyano, amino, substituted amino, alkylamino, dialkylamino, aminoalkyl, acylamino, amidino, amidoximo, hydroxamoyl, phenyl, aryl, substituted aryl, aryloxy, arylalkyl, arylalkenyl, arylalkynyl, pyridyl, imidazolyl, heteroaryl, substituted heteroaryl, heteroaryloxy, heteroarylalkyl, heteroarylalkenyl, heteroarylalkynyl, cyclopropyl, cyclobutyl, cyclopentyl, cyclohexyl, cycloalkyl, cycloalkenyl, cycloalkylalkyl, substituted cycloalkyl, cycloalkyloxy, pyrrolidinyl, piperidinyl, morpholino, heterocycle, (heterocycle)oxy, and (heterocycle)alkyl; where preferred heteroatoms are oxygen, nitrogen, and sulfur. Additionally, where open valences exist on these substitute chemical groups they can be further substituted with alkyl, cycloalkyl, aryl, heteroaryl, and/or heterocycle groups, that where these open valences exist on carbon they can be further substituted by halogen and by oxygen-, nitrogen-, or sulfur-bonded substituents, and where multiple such open valences exist, these groups can be joined to form a ring, either by direct formation of a bond or by formation of bonds to a new heteroatom, preferably oxygen, nitrogen, or sulfur. It is further contemplated that the above substitutions can be made provided that replacing the hydrogen with the substituent does not introduce unacceptable instability to the molecules of the present invention, and is otherwise chemically reasonable. One of ordinary skill in the art would understand that with respect to any chemical group described as optionally substituted, only sterically practical and/or synthetically feasible chemical groups are meant to be included. "Optionally substituted" as used herein refers to all subsequent modifiers in a term or series of chemical groups. For example, in the term "optionally substituted arylalkyl," the "alkyl" portion and the "aryl" portion of the molecule may or may not be substituted, and for the series "optionally substituted alkyl, cycloalkyl, aryl and heteroaryl," the alkyl, cycloalkyl, aryl, and heteroaryl groups, independently of the others, may or may not be substituted.

"Reaction" as used herein refers to a process in which one or more substances or compounds or substrates is converted into one or more different substances, compounds, or processes.

Conversion of Imines to Secondary Amines

Chemical synthesis of Compound (1), a substituted carbamoylmethylamino acetic acid derivative, is a multistep process. The low yield of this multistep chemical process makes the use of an enzyme with imine reductase activity an attractive alternative, as several steps maybe removed from the synthetic sequence.

Glucose dehydrogenase (GDH), the original member of the short chain dehydrogenase reductase family, is well-known for its NAD(P)-dependent oxidation of D-glucose to gluconolactone. It has been widely used in nicotinamide cofactor regeneration. Recently, the promiscuous imine reductase activity of GDH in the asymmetric reduction of cyclic iminium salts to cyclic chiral amines by a few GDH enzymes from different organisms was reported (Roth et al., ChemBioChem 2017, 18, 1703-1706). This preliminary report raises the question of whether, similar to IREDs, GDH enzymes might be useful to produce a range of chiral secondary or tertiary amines, including among others, acyclic amines, amino acid esters, and amino acids with alkyl chains (Scheme 1).

The initial report of GDH's promiscuity, while intriguing, focused on a small subset of imine reductase reactions using stable cyclic iminium salts that have limited utility in complex, multistep processes useful for synthesis of a range of secondary and tertiary chiral amines. The native substrate of GDH is cyclic, but biocatalysts having imine reductase activity find utility across a range substrates, including substrates that are acyclic, contain other functional groups present, or have alkyl chains, including branched chains. Additionally, enzymes that catalyze several process steps find particular use in preparing industrial and pharmaceutical compounds and intermediates.

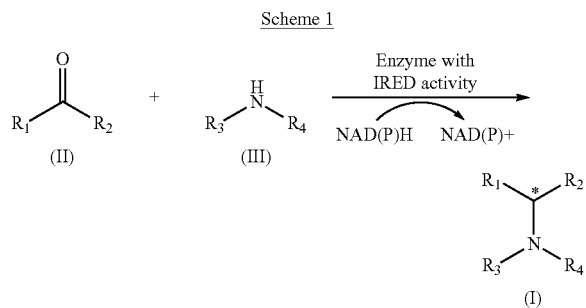

Scheme 1

The present invention provides novel biocatalysts and associated methods of use for the synthesis of chiral secondary amines by direct reductive amination of carbonyl and amine containing substrates. The biocatalysts of the present disclosure are engineered polypeptide variants of the wild-type gene from *Bacillus subtilis*, which encodes a glucose dehydrogenase having the amino acid sequence of SEQ ID NO:2. A variant (SEQ ID NO:4) of the wild-type glucose dehydrogenase, containing the following residue differences compared to SEQ ID NO:2: E170K, Q252L, I165M, P194T, was used as the starting point for protein engineering. These engineered polypeptides are capable of catalyzing the conversion of a carbonyl compound and an amine to a secondary amine. The general imine reductase activity of the IREDs and GDHs is illustrated above in Scheme 1.

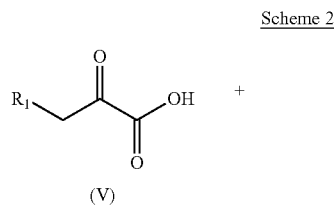

Scheme 2

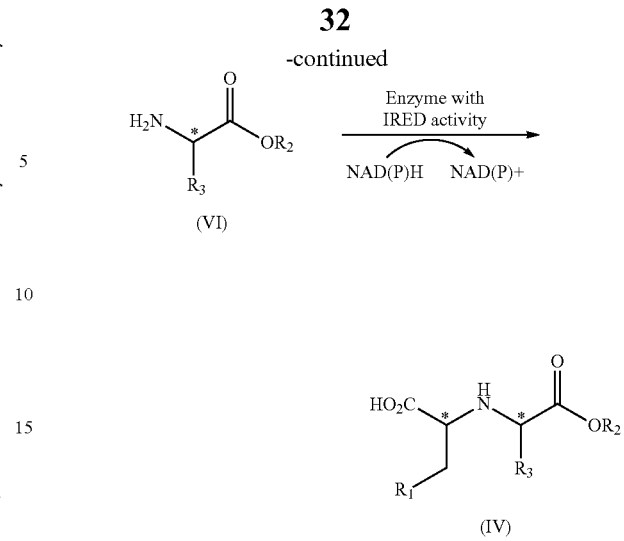

The engineered glucose dehydrogenase polypeptides of the present invention can accept a range of substrates. Accordingly, in the biocatalytic reaction of Scheme 2, the $R_1$ groups of the substrate are selected from a hydrogen atom, or optionally substituted alkyl, alkenyl, alkynyl, alkoxy, arylalkoxy, hydroxyalkyl, heteroalkyl, heteroalkenyl, heteroalkynyl, haloalkyl, alkylthioalkyl, cycloalkyl, aryl, arylalkyl, heterocycloalkyl, heteroaryl, and heteroarylalkyl; the $R_2$ groups of the substrate are independently selected from alkyl, alkenyl, alkynyl, hydroxyalkyl, carboxy, aminocarbonyl, heteroalkyl, heteroalkenyl, heteroalkynyl, carboxyalkyl, alkylamino, haloalkyl, alkylthioalkyl, cycloalkyl, aryl, arylalkyl, heterocycloalkyl, heteroaryl, and heteroarylalkyl; and the $R_3$ groups of the substrate are independently selected from methyl, d3-methyl and ethyl.

As described further herein, the engineered glucose dehydrogenase polypeptides having imine reductase activity exhibit stereoselectivity; thus, an imine reductase reaction of Scheme 2 can be used to establish one, or more, chiral centers of a product in a single biocatalytic reaction.

In some embodiments, the present invention provides an engineered polypeptide comprising an amino acid sequence having at least 80% sequence identity to an amino acid reference sequence of SEQ ID NO:4 and further comprising one or more amino acid residue differences as compared to the reference amino acid sequence, wherein the engineered glucose dehydrogenase polypeptide has imine reductase activity. In some embodiments of the engineered glucose dehydrogenase polypeptide, the imine reductase activity is the activity of Scheme 2.

In particular, the engineered glucose dehydrogenase polypeptides of the present disclosure have been engineered for efficient conversion of the keto-ester substrate, 3-[4-(3-chlorophenyl)phenyl]-2-oxo-propanoic acid (referred to herein as chloro-biphenylpyruvate and "Compound (2)") and the amine substrate, L-alanine ethyl ester (referred to herein as "Compound (3)"), to the corresponding chiral amine product compound, 3-[4-(3-chlorophenyl)phenyl]-2-[(2-ethoxy-1-methyl-2-oxo-ethyl)amino]propanoic acid (referred to herein as "Compound (1)") in aqueous conditions, as shown in Scheme 3.

Scheme 3

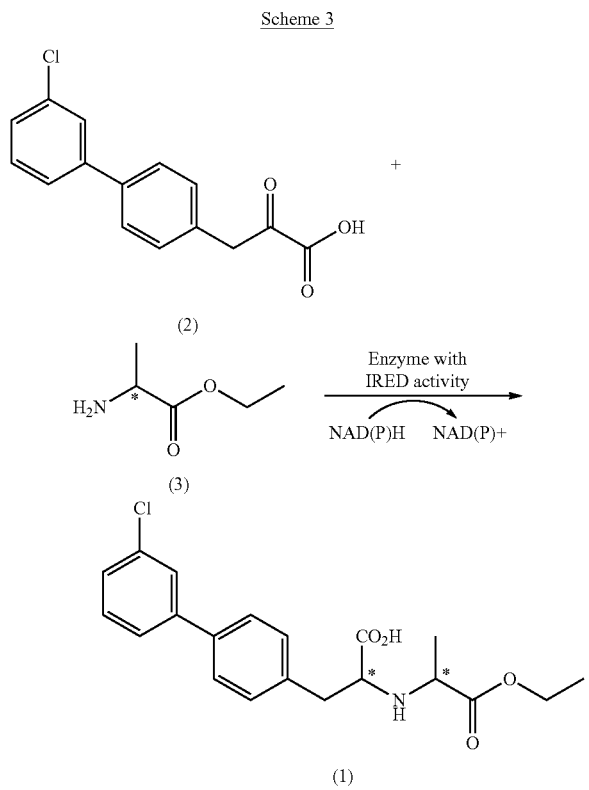

Engineered Glucose Dehydrogenase Polypeptides

The present invention provides glucose dehydrogenase polypeptides having imine reductase activity, polynucleotides encoding the polypeptides, methods of preparing the polypeptides, and methods for using the polypeptides. Where the description relates to polypeptides, it is to be understood that it can describe the polynucleotides encoding the polypeptides.

Suitable reaction conditions under which the above-described improved properties of the engineered polypeptides carry out the desired reaction can be determined with respect to concentrations or amounts of polypeptide, substrate, co-substrate, buffer, solvent, pH, conditions including temperature and reaction time, and/or conditions with the polypeptide immobilized on a solid support, as further described below and in the Examples.

In some embodiments, exemplary engineered glucose dehydrogenase polypeptides having imine reductase activity with improved properties, particularly in the conversion of Compound (2) and Compound (3) to Compound (1), comprise an amino acid sequence that has one or more residue differences as compared to SEQ ID NO:4 at the residue positions indicated in Table 5.1.

In some embodiments, exemplary engineered glucose dehydrogenase polypeptides having imine reductase activity with improved properties, particularly in the conversion of Compound (2) and Compound (3) to Compound (1), comprise an amino acid sequence that has one or more residue differences as compared to SEQ ID NO:14 at the residue positions indicated in Table 6.1.

In some embodiments, exemplary engineered glucose dehydrogenase polypeptides having imine reductase activity with improved properties, particularly in the conversion of Compound (2) and Compound (3) to Compound (1), comprise an amino acid sequence that has one or more residue differences as compared to SEQ ID NO:34 at the residue positions indicated in Table 7.1.

In some embodiments, exemplary engineered glucose dehydrogenase polypeptides having imine reductase activity with improved properties, particularly in the conversion of Compound (2) and Compound (3) to Compound (1), comprise an amino acid sequence that has one or more residue differences as compared to SEQ ID NO:112 at the residue positions indicated in Table 8.1.

In some embodiments, exemplary engineered glucose dehydrogenase polypeptides having imine reductase activity with improved properties, particularly in the conversion of Compound (2) and Compound (3) to Compound (1), comprise an amino acid sequence that has one or more residue differences as compared to SEQ ID NO:736 at the residue positions indicated in Table 9.1.

In some embodiments, exemplary engineered glucose dehydrogenase polypeptides having imine reductase activity with improved properties, particularly in the conversion of Compound (2) and Compound (3) to Compound (1), comprise an amino acid sequence that has one or more residue differences as compared to SEQ ID NO:908 at the residue positions indicated in Table 10.1.

In some embodiments, exemplary engineered glucose dehydrogenase polypeptides having imine reductase activity with improved properties, particularly in the conversion of Compound (2) and Compound (3) to Compound (1), comprise an amino acid sequence that has one or more residue differences as compared to SEQ ID NO:956 at the residue positions indicated in Table 11.1.

In some embodiments, exemplary engineered glucose dehydrogenase polypeptides having imine reductase activity with improved properties, particularly in the conversion of Compound (2) and Compound (3) to Compound (1), comprise an amino acid sequence that has one or more residue differences as compared to SEQ ID NO:1062 at the residue positions indicated in Table 12.1.

The structure and function information for exemplary non-naturally occurring (or engineered) polypeptides of the present invention are based on the conversion of Compound (2) and Compound (3) to Compound (1), the results of which are shown below in Tables 5.1, 6.1, 7.1, 8.1, 9.1, 10.1, 11.1 and 12.1, and further described in the Examples. The odd numbered sequence identifiers (i.e., SEQ ID NOs) in these Tables refer to the nucleotide sequence encoding the amino acid sequence provided by the even numbered SEQ ID NOs in these Tables. Exemplary sequences are provided in the electronic sequence listing file accompanying this invention, which is hereby incorporated by reference herein. The amino acid residue differences are based on comparison to the reference sequence of SEQ ID NO:4, 14, 34, 112, 736, 908, 956, and/or 1062, as indicated.

A GDH with improved glucose dehydrogenase activity (SEQ ID NO:4) was developed using the naturally occurring amino acid sequence of the *Bacillus subtilis* glucose dehydrogenase (SEQ ID NO:2) as the starting enzyme (see U.S. Pat. Nos. 7,816,111 and 7,939,309). SEQ ID NO:3 is a codon-optimized polynucleotide for expression in *Escherichia coli* that was synthesized based on the polypeptide sequence of SEQ ID NO:4. The engineered glucose dehydrogenase of SEQ ID NO:4 was discovered to have promiscuous imine reductase activity.

The activity of each engineered glucose dehydrogenase polypeptide relative to the reference polypeptide of SEQ ID NO:4, 14, 34, 112, 736, 908, 956, and/or 1062 was determined as conversion of the substrates described in the Examples herein. In some embodiments, a shake flask powder (SFP) is used as a secondary screen to assess the properties of the engineered glucose dehydrogenases, the results of which are provided in the Examples. In some embodiments, the SFP forms provide a more purified powder preparation of the engineered polypeptides and can contain the engineered polypeptides that are up to about 30% of total protein.

In some embodiments, the specific enzyme properties are associated with the residues differences as compared to SEQ ID NO: 4, 14, 34, 112, 736, 908, 956, and/or 1062 at the residue positions indicated herein. In some embodiments, residue differences affecting polypeptide expression can be used to increase expression of the engineered glucose dehydrogenase.

In light of the guidance provided herein, it is further contemplated that any of the exemplary engineered polypeptides comprising the even-numbered sequences of SEQ ID NOs: 6-1384 find use as the starting amino acid sequence for synthesizing other engineered glucose dehydrogenase polypeptides, for example by subsequent rounds of evolution that incorporate new combinations of various amino acid differences from other polypeptides in Tables 5.1, 6.1, 7.1, 8.1, 9.1, 10.1, 11.1 and 12.1, and other residue positions described herein. Further improvements may be generated by including amino acid differences at residue positions that had been maintained as unchanged throughout earlier rounds of evolution.

In some embodiments, the engineered glucose dehydrogenase polypeptide having imine reductase activity comprises an amino acid sequence having at least 80%, 85%, 86%, 87%, 88%, 89%, 90%, 91%, 92%, 93%, 94%, 95%, 96%, 97%, 98%, 99% or more sequence identity to reference sequence SEQ ID NO:4 and one or more residue differences as compared to SEQ ID NO:4, selected from: 49G, 96/118, 147, 155, 155/253, 195, 200, and 256. In some embodiments, the engineered glucose dehydrogenase polypeptide having imine reductase activity comprises an amino acid sequence having at least 80%, 85%, 86%, 87%, 88%, 89%, 90%, 91%, 92%, 93%, 94%, 95%, 96%, 97%, 98%, 99% or more sequence identity to reference sequence SEQ ID NO:4 and one or more residue differences as compared to SEQ ID NO:4, selected from: 96A, 96C/118M, 147A, 147I, 147S, 155A/253H, 155N, 195G, 200W, 256A, 256S, 256T, and 256V. In some embodiments, the engineered glucose dehydrogenase polypeptide having imine reductase activity comprises an amino acid sequence having at least 80%, 85%, 86%, 87%, 88%, 89%, 90%, 91%, 92%, 93%, 94%, 95%, 96%, 97%, 98%, 99% or more sequence identity to reference sequence SEQ ID NO:4 and one or more residue differences as compared to SEQ ID NO:4, selected from: E96A, E96C/T118M, H147A, H147I, H147S, F155A/Y253H, F155N, I195G, F200W, F256A, F256S, F256T, and F256V.

In some embodiments, the engineered glucose dehydrogenase polypeptide having imine reductase activity comprises an amino acid sequence having at least 80%, 85%, 86%, 87%, 88%, 89%, 90%, 91%, 92%, 93%, 94%, 95%, 96%, 97%, 98%, 99% or more sequence identity to reference sequence SEQ ID NO:14 and one or more residue differences as compared to SEQ ID NO:14, selected from: 17, 95/96, 95/96/118, 95/96/118/156/200/253, 95/96/147, 95/96/147/200, 95/96/147/200/253, 95/96/155/156, 95/96/155/195/200, 95/96/159/195/253, 95/155/156, 95/155/195/200, 95/155/200, 96, 96/147/195/200/253, 96/155, 96/155/159, 96/155/159/195, 96/155/159/200, 96/156/159/195, 96/156/159/195/200, 96/195, 147, 147/155, 147/155/156, 147/155/156/200, 147/155/159, 147/195/200/253, 155, 155/156, 155/156/195/200/253, 155/159/200, and 253. In some embodiments, the engineered glucose dehydrogenase polypeptide having imine reductase activity comprises an amino acid sequence having at least 80%, 85%, 86%, 87%, 88%, 89%, 90%, 91%, 92%, 93%, 94%, 95%, 96%, 97%, 98%, 99% or more sequence identity to reference sequence SEQ ID NO:14 and one or more residue differences as compared to SEQ ID NO:14, selected from: 17T, 95V/96A/118M/156T/200W/253H, 95V/96A/147Q/200W/253H, 95V/96C, 95V/96C/118M, 95V/96C/147Q, 95V/96C/147Q/200W, 95V/96C/155A/195G/200W, 95V/96C/155N/156Q, 95V/96C/159T/195G/253H, 95V/155N/156A, 95V/155N/159C/200W, 95V/155N/200W, 96A/147Q/195G/200W/253H, 96C/155A, 96C/155N/159C, 96C/155N/159C/195G, 96C/155N/159C/200W, 96C/155N/159T, 96C/156A/159T/195G/200W, 96C/156L/159T/195G, 96C/195G, 96S, 147Q/155N, 147Q/155N/156A/200W, 147Q/155N/156T, 147Q/155N/159C, 147Q/195G/200W/253H, 147T, 155N, 155N/156A, 155N/156T/195G/200W/253H, 155N/159C/200W, 155Q, 155R, 253G, and 253S. In some embodiments, the engineered glucose dehydrogenase polypeptide having imine reductase activity comprises an amino acid sequence having at least 80%, 85%, 86%, 87%, 88%, 89%, 90%, 91%, 92%, 93%, 94%, 95%, 96%, 97%, 98%, 99% or more sequence identity to reference sequence SEQ ID NO:14 and one or more residue differences as compared to SEQ ID NO:14, selected from: S17T, L95V/E96A/T118M/V156T/F200W/Y253H, L95V/E96A/I147Q/F200W/Y253H, L95V/E96C, L95V/E96C/T118M, L95V/E96C/I147Q, L95V/E96C/I147Q/F200W, L95V/E96C/F155A/I195G/F200W, L95V/E96C/F155N/V156Q, L95V/E96C/A159T/I195G/Y253H, L95V/F155N/V156A, L95V/F155N/A159C/F200W, L95V/F155N/F200W, E96A/I147Q/I195G/F200W/Y253H, E96C/F155A, E96C/F155N/A159C, E96C/F155N/A159C/I195G, E96C/F155N/A159C/F200W, E96C/F155N/A159T, E96C/V156A/A159T/I195G/F200W, E96C/V156L/A159T/I195G, E96C/I195G, E96S, I147Q/F155N, I147Q/F155N/V156A/F200W, I147Q/F155N/V156T, I147Q/F155N/A159C, I147Q/I195G/F200W/Y253H, I147T, F155N, F155N/V156A, F155N/V156T/I195G/F200W/Y253H, F155N/A159C/F200W, F155Q, F155R, Y253G, and Y253S.

In some embodiments, the engineered glucose dehydrogenase polypeptide having imine reductase activity comprises an amino acid sequence having at least 80%, 85%, 86%, 87%, 88%, 89%, 90%, 91%, 92%, 93%, 94%, 95%, 96%, 97%, 98%, 99% or more sequence identity to reference sequence SEQ ID NO:34 and one or more residue differences as compared to SEQ ID NO:34, selected from: 17, 17/21, 17/21/42, 17/21/42/155/260, 17/21/49, 17/21/49/51, 17/21/49/51/96, 17/21/49/51/260, 17/21/49/96/155/260, 17/21/49/260, 17/21/51/96, 17/21/51/195, 17/21/96, 17/21/96/155, 17/21/96/195/260, 17/21/96/253, 17/21/147/155/253, 17/21/155/253, 17/21/195, 17/21/253, 17/42, 17/42/49/195/260, 17/42/96, 17/44, 17/44/47/51/96, 17/44/47/51/96/114/147/195/199/253, 17/44/47/51/96/114/147/199, 17/44/47/51/96/114/195/199, 17/44/47/51/96/147/253, 17/44/47/51/178/195, 17/44/47/195/199, 17/44/51/114/195/253, 17/46/47/51/96/147, 17/46/47/51/96/195/253, 17/46/47/51/155, 17/46/47/51/155/195/199, 17/46/47/96/195, 17/46/47/178, 17/46/96/253, 17/47, 17/47/51, 17/47/51/96/114/147/195, 17/47/51/96/114/155/178/253, 17/47/51/96/195, 17/47/51/96/199, 17/47/96/114/155/253, 17/47/96/147/155/195/199, 17/47/96/147/195/199/253, 17/47/96/155, 17/47/96/195/199, 17/47/114, 17/47/114/155/195/199/253, 17/47/147/195/199/253, 17/49, 17/49/51, 17/49/51/96/195/253, 17/49/51/155/253, 17/49/51/155/253/260, 17/49/51/155/

260, 17/49/51/253, 17/49/96, 17/49/96/155/253, 17/49/96/ 195, 17/49/260, 17/51, 17/51/96/114, 17/51/96/155/178, 17/51/96/155/195/199, 17/51/96/155/199, 17/51/96/ 155/253, 17/51/96/178/195/199, 17/51/96/195, 17/51/96/ 260, 17/51/114, 17/51/114/253, 17/51/147, 17/51/155/195, 17/51/178/195/253, 17/51/253, 17/96, 17/96/114/147/155, 17/96/114/147/155/178/195/199, 17/96/147, 17/96/147/155, 17/96/155/178, 17/96/155/178/253, 17/96/155/195, 17/96/ 155/195/199, 17/96/178, 17/96/178/195, 17/96/195, 17/96/ 195/199, 17/96/195/199/253, 17/96/253, 17/114, 17/114/ 253, 17/147/155/253, 17/147/178, 17/147/199, 17/155, 17/155/178, 17/155/178/195, 17/155/195, 17/155/195/253, 17/155/199, 17/155/253, 17/178, 17/178/195/253, 17/195, 17/195/199, 17/195/199/253, 17/195/253, 17/199, 17/253, 17/260, 21/49/51, 21/49/96/195, 21/49/96/253, 21/49/195, 21/51/96/155, 21/96, 21/96/195, 21/96/253, 44/46/47/51/ 114/178/253, 44/46/47/51/155/178/253, 44/46/47/96/155/ 195, 44/46/51/96/147/178/195/199, 44/46/51/96/155/195/ 199/253, 44/46/51/96/195, 44/46/51/147/155/178/195/253, 44/47/51/96/114, 44/47/51/96/177/178/199/253, 44/47/51/ 114/178/253, 44/47/96/114, 44/47/96/195/253, 44/47/147/ 155, 44/47/147/155/199, 44/96/155/178, 46/47/51/96/114/ 178, 46/47/51/114/147/195/199, 46/47/51/155/195/199, 46/47/96/114/195/199, 46/47/96/155/178/195/253, 46/47/ 155/195/199, 46/114/147/155/178/195/199, 46/114/195/ 199/253, 47/51/96, 47/51/96/114, 47/51/96/147/155/195/ 199, 47/51/96/147/195/199, 47/51/96/178/195/199/253, 47/51/96/195, 47/51/96/195/199/253, 47/51/114/253, 47/51/ 155/178/195, 47/51/155/195/253, 47/96/114, 47/96/114/ 253, 47/96/155/178/195, 47/96/155/195, 47/96/155/195/ 199, 47/96/178/195/253, 47/96/178/253, 47/96/195/199/ 253, 47/96/195/253, 47/114, 47/114/155/195/199, 47/114/ 178, 47/147/195, 47/155/253, 47/178/195, 47/178/195/199, 47/195/199, 49/51/96, 49/96, 49/96/253, 51/96, 51/96/114/ 155/195/199/253, 51/96/155/178, 51/96/155/178/195/253, 51/96/155/195, 51/96/155/195/253, 51/96/195/253, 51/96/ 199, 51/96/253, 51/114/155/195/199, 51/114/195/199, 51/147/253, 51/155/195/199, 51/195, 51/253, 96, 96/114/ 147/155/195/199, 96/114/155/178/195/199/253, 96/114/ 155/195/253, 96/114/199, 96/147, 96/147/155/178/195/253, 96/147/178/195/199, 96/147/195, 96/147/195/199, 96/147/ 253, 96/155/178/199, 96/155/195, 96/155/199, 96/155/253, 96/178/195, 96/178/195/199, 96/195, 96/195/199, 96/195/ 253, 96/199, 96/199/253, 96/253,114, 114/147/155/253, 114/178/195/199/253, 114/195, 114/195/199/253, 132, 147/ 155, 149, 154, 155/178, 155/178/195/199, 155/195, 155/ 195/199, 155/195/199/253, 155/195/253, 155/253, 157, 167, 170, 178, 178/195, 178/199, 195, 196, 198, 214, 218, 251, 252, 256, 257, 259, and 260. In some embodiments, the engineered glucose dehydrogenase polypeptide having imine reductase activity comprises an amino acid sequence having at least 80%, 85%, 86%, 87%, 88%, 89%, 90%, 91%, 92%, 93%, 94%, 95%, 96%, 97%, 98%, 99% or more sequence identity to reference sequence SEQ ID NO:34 and one or more residue differences as compared to SEQ ID NO:34, selected from: 17T, 17T/21R, 17T/21R/42T, 17T/ 21R/42T/155R/260G, 17T/21R/49A, 17T/21R/49A/51L, 17T/21R/49A/51L/96S, 17T/21R/49A/51L/260G, 17T/21R/ 49A/96S/155R/260G, 17T/21R/49A/260G, 17T/21R/51L/ 96S, 17T/21R/51L/195N, 17T/21R/96S, 17T/21R/96S/ 155R, 17T/21R/96S/195N/260G, 17T/21R/96S/253L, 17T/ 21R/147T/155R/253L, 17T/21R/155R/253L, 17T/21R/ 195N, 17T/21R/253L, 17T/42T, 17T/42T/49A/195N/260G, 17T/42T/96S, 17T/44N, 17T/44N/47A/51A/96A, 17T/44N/ 47A/195N/199R, 17T/44N/47L/51A/96A/114A/147T/ 195G/199R/253G, 17T/44N/47L/51A/96S/114A/147T/ 199R, 17T/44N/47L/51A/96T/114A/195G/199R, 17T/44N/ 47S/51A/96T/147T/253G, 17T/44N/47S/51A/178S/195N, 17T/44N/47S/195G/199R, 17T/44N/51A/114A/195N/ 253G, 17T/46W/47A/96C/195G, 17T/46W/47A/178S, 17T/ 46W/47L/51A/96C/195G/253R, 17T/46W/47L/51A/96T/ 147T, 17T/46W/47L/51A/155Q, 17T/46W/47L/51A/155R/ 195G/199R, 17T/46W/96C/253G, 17T/47A/51A, 17T/47A/ 51A/96T/114A/147T/195G, 17T/47A/51A/96T/114A/ 155R/178S/253R, 17T/47A/96A/155Q, 17T/47A/96T/ 147T/195G/199R/253G, 17T/47A/147T/195G/199R/253S, 17T/47L/51A/96T/195G, 17T/47L/51A/96T/195G/199R, 17T/47L/96A/114A/155Q/253G, 17T/47L/114A, 17T/47L/ 114A/155R/195G/199R/253S, 17T/47S, 17T/47S/96C/ 147T/155Q/195G/199R, 17T/47S/96C/195N/199R, 17T/ 49A, 17T/49A/51L, 17T/49A/51L/96S/195N/253L, 17T/ 49A/51L/155R/253L, 17T/49A/51L/155R/253L/260G, 17T/49A/51L/155R/260G, 17T/49A/51L/253L, 17T/49A/ 96S, 17T/49A/96S/155R/253L, 17T/49A/96S/195N, 17T/ 49A/260G, 17T/51A/96C/155Q/195G/199R/253G, 17T/ 51A/96C/155R/178S, 17T/51A/96C/195N, 17T/51A/96S/ 114A, 17T/51A/96S/155Q/199R, 17T/51A/96T/155R/ 195G/199R/253S, 17T/51A/96T/178S/195G/199R, 17T/ 51A/114A, 17T/51A/114A/253R, 17T/51A/147T, 17T/51A/ 155R/195G, 17T/51A/178S/195G/253G, 17T/51L, 17T/ 51L/96S/155R/253L, 17T/51L/96S/260G, 17T/51L/253L, 17T/96A/147T/155R, 17T/96A/155Q/195G/199R, 17T/ 96A/155R/178S/253G, 17T/96A/195N/199R, 17T/96C, 17T/96C/114A/147T/155Q, 17T/96C/178S/195G, 17T/ 96C/195G/199R, 17T/96S/114A/147T/155Q/178S/195G/ 199R, 17T/96S/155R/178S, 17T/96S/155R/195N, 17T/96S/ 178S, 17T/96S/195N, 17T/96S/253L, 17T/96T, 17T/96T/ 147T, 17T/96T/195G/199R, 17T/96T/195G/199R/253R, 17T/96T/253R, 17T/114A, 17T/114A/253R, 17T/147T/ 155Q/253G, 17T/147T/178S, 17T/147T/199R, 17T/155Q, 17T/155Q/178S, 17T/155Q/195G/253S, 17T/155Q/199R, 17T/155R, 17T/155R/178S, 17T/155R/178S/195G, 17T/ 155R/195G, 17T/155R/253G, 17T/155R/253L, 17T/178S, 17T/178S/195N/253S, 17T/195G, 17T/195G/199R, 17T/ 195G/199R/253S, 17T/195N, 17T/195N/199R, 17T/195N/ 253L, 17T/199R, 17T/253L, 17T/260G, 21R/49A/51L, 21R/49A/96S/195N, 21R/49A/96S/253L, 21R/49A/195N, 21R/51L/96S/155R, 21R/96S, 21R/96S/195N, 21R/96S/ 253L, 44N/46W/47A/51A/155R/178S/253G, 44N/46W/ 47L/51A/114A/178S/253G, 44N/46W/47L/96C/155R/ 195G, 44N/46W/51A/96A/147T/178S/195G/199R, 44N/ 46W/51A/96T/155R/195G/199R/253G, 44N/46W/51A/ 96T/195G, 44N/46W/51A/147T/155R/178S/195G/253G, 44N/47A/51A/96T/177T/178S/199R/253S, 44N/47L/96T/ 114A, 44N/47S/51A/96S/114A, 44N/47S/51A/114A/178S/ 253S, 44N/47S/96T/195N/253G, 44N/47S/147T/155Q, 44N/47S/147T/155Q/199R, 44N/96C/155R/178S, 46W/ 47A/51A/114A/147T/195G/199R, 46W/47A/51A/155R/ 195G/199R, 46W/47L/51A/96T/114A/178S, 46W/47L/ 96C/155R/178S/195G/253S, 46W/47L/96T/114A/195N/ 199R, 46W/47L/155R/195N/199R, 46W/114A/147T/155Q/ 178S/195G/199R, 46W/114A/195G/199R/253S, 47A/51A/ 96C/178S/195G/199R/253G, 47A/51A/96T/195G, 47A/ 51A/155R/195G/253G, 47A/96S/114A, 47A/96S/195N/ 253S, 47A/96T/155Q/178S/195G, 47A/96T/155Q/195N/ 199R, 47A/96T/178S/195N/253R, 47A/114A, 47A/147T/ 195G, 47A/178S/195N/199R, 47L/51A/96C/147T/195G/ 199R, 47L/51A/96C/195G/199R/253G, 47L/51A/96S/ 147T/155Q/195G/199R, 47L/51A/155Q/195G/253S, 47L/ 96A/195G/199R/253S, 47L/96T/114A/253R, 47L/96T/ 178S/253G, 47L/114A/155R/195G/199R, 47L/114A/178S/ 253G, 47L/195N/199R, 47S/51A/96A, 47S/51A/96C/114A, 47S/ 51A/96C/195G, 47S/51A/114A/253S, 47S/51A/155R/ 178S/195N, 47S/96S/155R/195G, 47S/96T/195G/253S, 47S/155R/253G, 47S/178S/195G, 49A/51L/96S, 49A/96S, 49A/96S/253L, 51A/96C/114A/155Q/195G/199R/253G, 51A/96C/155Q/195G/253G, 51A/96C/155R/178S, 51A/96C/155R/178S/195G/253R, 51A/96S/155Q/195G, 51A/96S/199R, 51A/96T/195G/253G, 51A/96T/199R, 51A/96T/253R, 51A/114A/155Q/195G/199R, 51A/114A/195G/199R, 51A/147T/253S, 51A/155Q/195N/199R, 51A/195G, 51A/195N, 51A/253G, 51L/96S, 51L/195N, 96A, 96A/114A/155R/178S/195G/199R/253G, 96A/147T, 96A/147T/155R/178S/195G/253G, 96A/147T/195G, 96A/147T/195G/199R, 96A/147T/253R, 96A/195G, 96A/195G/199R, 96C, 96C/114A/147T/155R/195G/199R, 96C/147T/195G/199R, 96C/155R/195G, 96C/178S/195G/199R, 96C/195G/199R, 96C/199R, 96C/253S, 96G, 96K, 96N, 96S, 96S/114A/155Q/195N/253S, 96S/147T, 96S/155R/253L, 96S/195N, 96S/195N/253L, 96S/253G, 96S/253S, 96T, 96T/114A/199R, 96T/147T/178S/195N/199R, 96T/155Q/178S/199R, 96T/155Q/199R, 96T/178S/195G, 96T/178S/195N, 96T/195G, 96T/195G/253G, 96T/195G/253R, 96T/195N/199R, 96T/199R, 96T/199R/253S, 96T/253G, 114A, 114A/147T/155Q/253S, 114A/178S/195G/199R/253S, 114A/195G, 114A/195G/199R/253G, 132L, 147T/155R, 149D, 149E, 154E, 155Q/178S, 155Q/178S/195G/199R, 155Q/178S/195N/199R, 155Q/195G/253G, 155Q/195N, 155Q/195N/199R, 155R/195G/199R/253G, 155R/195N/199R/253R, 155R/195N/253L, 155R/253S, 157N, 167G, 167Q, 170Q, 178A, 178G, 178K, 178S, 178S/195N, 178S/199R, 195G, 195N, 195R, 195S, 196G, 196H, 198H, 214G, 218P, 251A, 251L, 252A, 252T, 256I, 257E, 257W, 259D, 259E, and 260E. In some embodiments, the engineered glucose dehydrogenase polypeptide having imine reductase activity comprises an amino acid sequence having at least 80%, 85%, 86%, 87%, 88%, 89%, 90%, 91%, 92%, 93%, 94%, 95%, 96%, 97%, 98%, 99% or more sequence identity to reference sequence SEQ ID NO:34 and one or more residue differences as compared to SEQ ID NO:34, selected from: S17T, S17T/K21R, S17T/K21R/K42T, S17T/K21R/K42T/N155R/R260G, S17T/K21R/K49A, S17T/K21R/K49A/E51L, S17T/K21R/K49A/E51L/E96S, S17T/K21R/K49A/E51L/R260G, S17T/K21R/K49A/E96S/N155R/R260G, S17T/K21R/K49A/R260G, S17T/K21R/E51L/E96S, S17T/K21R/E51L/I195N, S17T/K21R/E96S, S17T/K21R/E96S/N155R, S17T/K21R/E96S/I195N/R260G, S17T/K21R/E96S/Y253L, S17T/K21R/I147T/N155R/Y253L, S17T/K21R/N155R/Y253L, S17T/K21R/I195N, S17T/K21R/Y253L, S17T/K42T, S17T/K42T/K49A/I195N/R260G, S17T/K42T/E96S, S17T/D44N, S17T/D44N/E47A/E51A/E96A, S17T/D44N/E47A/I195N/K199R, S17T/D44N/E47L/E51A/E96A/G114A/I147T/I195G/K199R/Y253G, S17T/D44N/E47L/E51A/E96S/G114A/I147T/K199R, S17T/D44N/E47L/E51A/E96T/G114A/I195G/K199R, S17T/D44N/E47S/E51A/E96T/I147T/Y253G, S17T/D44N/E47S/E51A/P178S/I195N, S17T/D44N/E47S/I195G/K199R, S17T/D44N/E51A/G114A/I195N/Y253G, S17T/N46W/E47A/E96C/I195G, S17T/N46W/E47A/P178S, S17T/N46W/E47L/E51A/E96C/I195G/Y253R, S17T/N46W/E47L/E51A/E96T/I147T, S17T/N46W/E47L/E51A/N155Q, S17T/N46W/E47L/E51A/N155R/I195G/K199R, S17T/N46W/E96C/Y253G, S17T/E47A/E51A, S17T/E47A/E51A/E96T/G114A/I147T/I195G, S17T/E47A/E51A/E96T/G114A/N155R/P178S/Y253R, S17T/E47A/E96A/N155Q, S17T/E47A/E96T/I147T/I195G/K199R/Y253S, S17T/E47A/I147T/I195G/K199R/Y253S, S17T/E47L/E51A/E96T/I195G, S17T/E47L/E51A/E96T/I195G/K199R, S17T/E47L/E96A/G114A/N155Q/Y253G, S17T/E47L/G114A, S17T/E47L/G114A/N155R/I195G/K199R/Y253S, S17T/E47S, S17T/E47S/E96C/I147T/N155Q/I195G/K199R, S17T/E47S/E96C/I195N/K199R, S17T/K49A, S17T/K49A/E51L, S17T/K49A/E51L/E96S/I195N/Y253L, S17T/K49A/E51L/N155R/Y253L, S17T/K49A/E51L/N155R/Y253L/R260G, S17T/K49A/E51L/N155R/R260G, S17T/K49A/E51L/Y253L, S17T/K49A/E96S, S17T/K49A/E96S/N155R/Y253L, S17T/K49A/E96S/I195N, S17T/K49A/R260G, S17T/E51A/E96C/N155Q/I195G/K199R/Y253G, S17T/E51A/E96C/N155R/P178S, S17T/E51A/E96C/I195N, S17T/E51A/E96S/G114A, S17T/E51A/E96S/N155Q/K199R, S17T/E51A/E96T/N155R/I195G/K199R/Y253S, S17T/E51A/E96T/P178S/I195G/K199R, S17T/E51A/G114A, S17T/E51A/G114A/Y253R, S17T/E51A/I147T, S17T/E51A/N155R/I195G, S17T/E51A/P178S/I195G/Y253G, S17T/E51L, S17T/E51L/E96S/N155R/Y253L, S17T/E51L/E96S/R260G, S17T/E51L/Y253L, S17T/E96A/I147T/N155R, S17T/E96A/N155Q/I195G/K199R, S17T/E96A/N155R/P178S/Y253G, S17T/E96A/I195N/K199R, S17T/E96C, S17T/E96C/G114A/I147T/N155Q, S17T/E96C/P178S/I195G, S17T/E96C/I195G/K199R, S17T/E96S/G114A/I147T/N155Q/P178S/I195G/K199R, S17T/E96S/N155R/P178S, S17T/E96S/N155R/I195N, S17T/E96S/P178S, S17T/E96S/I195N, S17T/E96S/Y253L, S17T/E96T, S17T/E96T/I147T, S17T/E96T/I195G/K199R, S17T/E96T/I195G/K199R/Y253R, S17T/E96T/Y253R, S17T/G114A, S17T/G114A/Y253R, S17T/I147T/N155Q/Y253G, S17T/I147T/P178S, S17T/I147T/K199R, S17T/N155Q, S17T/N155Q/P178S, S17T/N155Q/I195G/Y253S, S17T/N155Q/K199R, S17T/N155R, S17T/N155R/P178S, S17T/N155R/P178S/I195G, S17T/N155R/I195G, S17T/N155R/Y253G, S17T/N155R/Y253L, S17T/P178S, S17T/P178S/I195N/Y253S, S17T/I195G, S17T/I195G/K199R, S17T/I195G/K199R/Y253S, S17T/I195N, S17T/I195N/K199R, S17T/I195N/Y253L, S17T/K199R, S17T/Y253L, S17T/R260G, K21R/K49A/E51L, K21R/K49A/E96S/I195N, K21R/K49A/E96S/Y253L, K21R/K49A/I195N, K21R/E51L/E96S/N155R, K21R/E96S, K21R/E96S/I195N, K21R/E96S/Y253L, D44N/N46W/E47A/E51A/N155R/P178S/Y253G, D44N/N46W/E47L/E51A/G114A/P178S/Y253G, D44N/N46W/E47L/E96C/N155R/I195G, D44N/N46W/E51A/E96A/I147T/P178S/I195G/K199R, D44N/N46W/E51A/E96T/N155R/I195G/K199R/Y253G, D44N/N46W/E51A/E96T/N155R/I147T/N155R/P178S/I195G/Y253G, D44N/N46W/E51A/I147T/N155R/P178S/I195G/Y253G, D44N/E47A/E51A/E96T/A177T/P178S/K199R/Y253S, D44N/E47L/E96T/G114A, D44N/E47S/E51A/E96S/G114A, D44N/E47S/E51A/G114A/P178S/Y253S, D44N/E47S/E96T/I195N/Y253G, D44N/E47S/I147T/N155Q, D44N/E47S/I147T/N155Q/K199R, D44N/E96C/N155R/P178S, N46W/E47A/E51A/G114A/I147T/I195G/K199R, N46W/E47A/E51A/N155R/I195G/K199R, N46W/E47L/E51A/E96T/G114A/P178S, N46W/E47L/E96C/N155R/P178S/I195G/Y253S, N46W/E47L/E96T/G114A/I195N/K199R, N46W/E47L/N155R/I195N/K199R, N46W/G114A/I147T/N155Q/P178S/I195G/K199R, N46W/G114A/I195G/K199R/Y253S, E47A/E51A/E96C/P178S/I195G/K199R/Y253G, E47A/E51A/E96T/I195G, E47A/E51A/N155R/I195G/Y253G, E47A/E96S/G114A, E47A/E96S/I195N/Y253S, E47A/E96T/N155Q/P178S/I195G, E47A/E96T/N155Q/I195N/K199R, E47A/E96T/P178S/I195N/Y253R, E47A/G114A, E47A/I147T/I195G, E47A/P178S/I195N/K199R, E47L/E51A/E96C/I147T/I195G/K199R, E47L/E51A/E96C/I195G/K199R/Y253G, E47L/E51A/E96S/I147T/N155Q/I195G/K199R, E47L/E51A/N155Q/I195G/Y253S, E47L/E96A/I195G/K199R/Y253S, E47L/E96T/G114A/Y253R, E47L/E96T/P178S/Y253G, E47L/G114A/N155R/I195G/K199R, E47L/G114A/P178S, E47L/I195N/K199R, E47S/E51A/E96A, E47S/E51A/E96C/G114A, E47S/E51A/E96C/I195G, E47S/E51A/G114A/Y253S, E47S/E51A/N155R/P178S/ I195N, E47S/E96S/N155R/I195G, E47S/E96T/I195G/ Y253S, E47S/N155R/Y253G, E47S/P178S/I195G, K49A/ E51L/E96S, K49A/E96S, K49A/E96S/Y253L, E51A/ E96C/G114A/N155Q/I195G/K199R/Y253G, E51A/E96C/ N155Q/I195G/Y253G, E51A/E96C/N155R/P178S, E51A/ E96C/N155R/P178S/I195G/Y253R, E51A/E96S/N155Q/ I195G, E51A/E96S/K199R, E51A/E96T/I195G/Y253G, E51A/E96T/K199R, E51A/E96T/Y253R, E51A/G114A/ N155Q/I195G/K199R, E51A/G114A/I195G/K199R, E51A/ I147T/Y253S, E51A/N155Q/I195N/K199R, E51A/I195G, E51A/I195N, E51A/Y253G, E51L/E96S, E51L/I195N, E96A, E96A/G114A/N155R/P178S/I195G/K199R/Y253G, E96A/I147T, E96A/I147T/N155R/P178S/I195G/Y253G, E96A/I147T/I195G, E96A/I147T/I195G/K199R, E96A/ I147T/Y253R, E96A/I195G, E96A/I195G/K199R, E96C, E96C/G114A/I147T/N155R/I195G/K199R, E96C/I147T/ I195G/K199R, E96C/N155R/I195G, E96C/P178S/I195G/ K199R, E96C/I195G/K199R, E96C/K199R, E96C/Y253S, E96G, E96K, E96N, E96S, E96S/G114A/N155Q/I195N/ Y253S, E96S/I147T, E96S/N155R/Y253L, E96S/I195N, E96S/I195N/Y253L, E96S/Y253G, E96S/Y253S, E96T, E96T/G114A/K199R, E96T/I147T/P178S/I195N/K199R, E96T/N155Q/P178S/K199R, E96T/N155Q/K199R, E96T/ P178S/I195G, E96T/P178S/I195N, E96T/I195G, E96T/ I195G/Y253G, E96T/I195G/Y253R, E96T/I195N/K199R, E96T/K199R, E96T/K199R/Y253S, E96T/Y253G, GI 14A, G114A/I147T/N155Q/Y253S, G114A/P178S/I195G/ K199R/Y253S, G114A/I195G, G114A/I195G/K199R/ Y253G, V132L, I147T/N155R, V149D, V149E, L154E, N155Q/P178S, N155Q/P178S/I195G/K199R, N155Q/ P178S/I195N/K199R, N155Q/I195G/Y253G, N155Q/ I195N, N155Q/I195N/K199R, N155R/I195G/K199R/ Y253G, N155R/I195N/K199R/Y253R, N155R/I195N/ Y253L, N155R/Y253S, H157N, L167G, L167Q, K170Q, P178A, P178G, P178K, P178S, P178S/I195N, P178S/ K199R, I195G, I195N, I195R, I195S, N196G, N196H, E198H, P214G, I218P, T251A, T251L, L252A, L252T, F256I, Q257E, Q257W, G259D, G259E, and R260E.

In some embodiments, the engineered glucose dehydrogenase polypeptide having imine reductase activity comprises an amino acid sequence having at least 80%, 85%, 86%, 87%, 88%, 89%, 90%, 91%, 92%, 93%, 94%, 95%, 96%, 97%, 98%, 99% or more sequence identity to reference sequence SEQ ID NO:112 and one or more residue differences as compared to SEQ ID NO:112, selected from: 21/42/96/178/195/253, 21/42/96/195, 21/96, 21/96/147/195, 21/96/149, 21/96/155/195/253, 21/96/167, 21/96/167/195, 21/96/178, 21/96/179/195/251/253, 21/96/195, 21/147/149, 21/147/253, 21/149/178/195, 21/155/178/253/256, 21/178/ 195/256, 42/96/149/253/256, 94, 96, 96/114/155/198/218/ 253/256/257, 96/114/155/252/253/257, 96/114/155/253, 96/114/196/214/253/256, 96/114/214/253/256, 96/147, 96/147/149, 96/147/149/155, 96/147/167/195, 96/149/155/ 167/178/253, 96/149/155/195, 96/149/178/179/251/256, 96/149/178/253, 96/149/198/252/253/257, 96/155, 96/155/ 167, 96/155/167/178, 96/155/195, 96/155/196/218/253/256/ 257, 96/155/196/252/253, 96/155/198, 96/155/252/253, 96/167, 96/178, 96/178/179/195, 96/195, 96/196, 96/196/ 198, 96/196/201/256, 96/251/253/256, 96/253/257, 96/256/ 257, 98, 103, 114/253/256/257, 147, 147/149, 149/167, 149/195, 149/218, 149/253, 149/257, 155/167, 155/178/195, 155/178/195/251/253, 155/195/251/253/256, 155/195/253/ 256, 155/196/198/253, 167, 167/195, 167/195/251/253, 196, 196/253/256/257, 198/253/256, 198/256, 205, 214/253/256, 251, and 257. In some embodiments, the engineered glucose dehydrogenase polypeptide having imine reductase activity comprises an amino acid sequence having at least 80%, 85%, 86%, 87%, 88%, 89%, 90%, 91%, 92%, 93%, 94%, 95%, 96%, 97%, 98%, 99% or more sequence identity to reference sequence SEQ ID NO: 112 and one or more residue differences as compared to SEQ ID NO:112, selected from: 21R/42T/96C/178S/195N/253G, 21R/42T/ 96S/195R, 21R/96C/147T/195R, 21R/96C/149E, 21R/96C/ 178S, 21R/96C/195R, 21R/96G/155N/195R/253G, 21R/ 96G/167Q/195N, 21R/96K/167Q, 21R/96S, 21R/96S/178S, 21R/96S/179N/195N/251A/253G, 21R/147T/149E, 21R/ 147T/253G, 21R/149E/178S/195N, 21R/155N/178S/253G/ 256I, 21R/178S/195R/256I, 42T/96C/149E/253G/256I, 94A, 96A/149E/155N/167Q/178S/253G, 96A/155N/167Q, 96C, 96C/114G/155N/252A/253G/257W, 96C/114G/155N/ 253R, 96C/114G/196G/214G/253G/256I, 96C/147T, 96C/ 147T/149E/155C, 96C/147T/167Q/195N, 96C/149D/198H/ 252A/253R/257E, 96C/149E/155N/195N, 96C/149E/155N/ 195R, 96C/155N/196G/218P/253G/256I/257E, 96C/155N/ 196G/252T/253G, 96C/155N/198H, 96C/155N/252T/253R, 96C/195N, 96C/196G/198H, 96C/196G/201P/256I, 96G/ 149E/178S/253G, 96G/155N/167Q, 96G/155N/195R, 96K/ 155N, 96K/178S, 96S, 96S/114G/155N/198H/218P/253R/ 256I/257E, 96S/114G/214G/253G/256I, 96S/147T/149E, 96S/149E/178S/179N/251A/256I, 96S/155N, 96S/155N/ 167Q/178S, 96S/167Q, 96S/178S, 96S/178S/179N/195N, 96S/195N, 96S/196G, 96S/251A/253G/256I, 96S/253G/ 257E, 96S/256I/257E, 98A, 103L, 114G/253G/256I/257E, 147A, 147R, 147T, 147T/149E, 149D/257E, 149E/167Q, 149E/195N, 149E/218P, 149E/253G, 155N/167Q, 155N/ 178S/195R, 155N/178S/195R/251A/253G, 155N/195N/ 251A/253G/256I, 155N/195N/253G/256I, 155N/196G/ 198H/253G, 167Q, 167Q/195N, 167Q/195N/251A/253G, 196A, 196G/253G/256I/257W, 198H/253G/256I, 198H/ 256I, 205E, 214G/253G/256I, 251L, and 257E. In some embodiments, the engineered glucose dehydrogenase polypeptide having imine reductase activity comprises an amino acid sequence having at least 80%, 85%, 86%, 87%, 88%, 89%, 90%, 91%, 92%, 93%, 94%, 95%, 96%, 97%, 98%, 99% or more sequence identity to reference sequence SEQ ID NO:112 and one or more residue differences as compared to SEQ ID NO:112, selected from: K21R/K42T/E96C/ P178S/G195N/S253G, K21R/K42T/E96S/G195R, K21R/ E96C/I147T/G195R, K21R/E96C/V149E, K21R/E96C/ P178S, K21R/E96C/G195R, K21R/E96G/R155N/G195R/ S253G, K21R/E96G/L167Q/G195N, K21R/E96K/L167Q, K21R/E96S, K21R/E96S/P178S, K21R/E96S/K179N/ G195N/T251A/S253G, K21R/I147T/V149E, K21R/I147T/ S253G, K21R/V149E/P178S/G195N, K21R/R155N/ P178S/S253G/F256I, K21R/P178S/G195R/F256I, K42T/ E96C/V149E/S253G/F256I, G94A, E96A/V149E/R155N/ L167Q/P178S/S253G, E96A/R155N/L167Q, E96C, E96C/ A114G/R155N/L252A/S253G/Q257W, E96C/A114G/ R155N/S253R, E96C/A114G/N196G/P214G/S253G/ F256I, E96C/I147T, E96C/I147T/V149E/R155C, E96C/ I147T/L167Q/G195N, E96C/V149D/E198H/L252A/ S253R/Q257E, E96C/V149E/R155N/G195N, E96C/ V149E/R155N/G195R, E96C/R155N/N196G/I218P/ S253G/F256I/Q257E, E96C/R155N/N196G/L252T/S253G, E96C/R155N/E198H, E96C/R155N/L252T/S253R, E96C/ G195N, E96C/N196G/E198H, E96C/N196G/A201P/F256I, E96G/V149E/P178S/S253G, E96G/R155N/L167Q, E96G/ R155N/G195R, E96K/R155N, E96K/P178S, E96S, E96S/ A114G/R155N/E198H/I218P/S253R/F256I/Q257E, E96S/ A114G/P214G/S253G/F256I, E96S/I147T/V149E, E96S/ V149E/P178S/K179N/T251A/F256I, E96S/R155N, E96S/ R155N/L167Q/P178S, E96S/L167Q, E96S/P178S, E96S/

P178S/K179N/G195N, E96S/G195N, E96S/N196G, E96S/ T251A/S253G/F256I, E96S/S253G/Q257E, E96S/F256I/ Q257E, P98A, E103L, A114G/S253G/F256I/Q257E, V149E/L167Q, V149E/G195N, V149E/I218P, V149E/ S253G, R155N/L167Q, R155N/P178S/G195R, R155N/ P178S/G195R/T251A/S253G, R155N/G195N/T251A/ S253G/F256I, R155N/G195N/S253G/F256I, R155N/ N196G/E198H/S253G, L167Q, L167Q/G195N, L167Q/ G195N/T251A/S253G, N196A, N196G/S253G/F256I/ Q257W, E198H/S253G/F256I, E198H/F256I, Q205E, P214G/S253G/F256I, T251L, and Q257E.
I147A, I147R, I147T, I147T/V149E, V149D/Q257E, In some embodiments, the engineered glucose dehydrogenase polypeptide having imine reductase activity comprises an amino acid sequence having at least 80%, 85%, 86%, 87%, 88%, 89%, 90%, 91%, 92%, 93%, 94%, 95%, 96%, 97%, 98%, 99% or more sequence identity to reference sequence SEQ ID NO:736 and one or more residue differences as compared to SEQ ID NO:736, selected from: 21/47/96/114/155/251, 21/47/149/257, 21/47/155/178/257, 21/47/178, 21/47/178/251/256/257, 21/96/114/155/178, 21/114/155/251/257, 21/114/178/179, 21/155/178/209/256, 25/155, 25/178/256, 42/47/155/178, 47/114/149/178/251, 47/114/178/257, 47/149, 47/178, 47/178/179/251/257, 47/178/251/257, 96/114/155/198, 96/114/155/253/257, 96/253,114/149/155/251/256, 114/149/178/256/257, 114/ 155/195/198/256, 114/209/256/257, 149, 149/256/257, 155, 155/178/179, 155/178/198/252/253, 155/195/198, 155/195/ 198/253/256/257, 155/256/257, 178/253, 178/256, 179/256/ 257, 251, and 253. In some embodiments, the engineered glucose dehydrogenase polypeptide having imine reductase activity comprises an amino acid sequence having at least 80%, 85%, 86%, 87%, 88%, 89%, 90%, 91%, 92%, 93%, 94%, 95%, 96%, 97%, 98%, 99% or more sequence identity to reference sequence SEQ ID NO:736 and one or more residue differences as compared to SEQ ID NO:736 selected from: 21R/47A/96A/114G/155N/251A, 21R/47A/149E/ 257E, 21R/47A/155N/178S/257E, 21R/47A/178S, 21R/ 47A/178S/251A/256I/257W, 21R/96A/114G/155N/178S, 21R/114G/155N/251A/257E, 21R/114G/178S/179N, 21R/ 155N/178S/209L/256I, 25L/155N, 25L/178S/256I, 42T/ 47A/155N/178S, 47A/114G/149E/178S/251A, 47A/114G/ 178S/257E, 47A/149E, 47A/178S, 47A/178S/179N/251A/ 257E, 47A/178S/251A/257E, 96I/114G/155N/198L, 96T/ 114G/155N/253G/257W, 96T/253G, 114G/149E/155N/ 251A/256I, 114G/149E/178S/256I/257E, 114G/155N/ 195N/198L/256I, 114G/209L/256I/257E, 149E, 149E/256I/ 257E, 155N, 155N/178S/179N, 155N/178S/198H/252T/ 253G, 155N/195N/198H/253G/256I/257W, 155N/195N/ 198L, 155N/256I/257E, 178S/253G, 178S/256I, 179N/256I/ 257E, 251I, 251L, and 253G. In some embodiments, the engineered glucose dehydrogenase polypeptide having imine reductase activity comprises an amino acid sequence having at least 80%, 85%, 86%, 87%, 88%, 89%, 90%, 91%, 92%, 93%, 94%, 95%, 96%, 97%, 98%, 99% or more sequence identity to reference sequence SEQ ID NO:736 and one or more residue differences as compared to SEQ ID NO:736, selected from: K21R/L47A/E96A/A114G/R155N/ T251A, K21R/L47A/V149E/Q257E, K21R/L47A/R155N/ P178S/Q257E, K21R/L47A/P178S, K21R/L47A/P178S/ T251A/F256I/Q257W, K21R/E96A/A114G/R155N/P178S, K21R/A114G/R155N/T251A/Q257E, K21R/A114G/ P178S/K179N, K21R/R155N/P178S/V209L/F256I, 125L/ R155N, 125L/P178S/F256I, K42T/L47A/R155N/P178S, L47A/A114G/V149E/P178S/T251A, L47A/A114G/P178S/ Q257E, L47A/V149E, L47A/P178S, L47A/P178S/K179N/ T251A/Q257E, L47A/P178S/T251A/Q257E, E96T/A114G/ R155N/E198L, E96T/A114G/R155N/S253G/Q257W, E96T/S253G, A114G/V149E/R155N/T251A/F256I, A114G/V149E/P178S/F256I/Q257E, A114G/R155N/ G195N/E198L/F256I, A114G/V209L/F256I/Q257E, V149E, V149E/F256I/Q257E, R155N, R155N/P178S/ K179N, R155N/P178S/E198H/L252T/S253G, R155N/ G195N/E198H/S253G/F256I/Q257W, R155N/G195N/ E198L, R155N/F256I/Q257E, P178S/S253G, P178S/F256I, K179N/F256I/Q257E, T251I, T251L, and S253G.

In some embodiments, the engineered glucose dehydrogenase polypeptide having imine reductase activity comprises an amino acid sequence having at least 80%, 85%, 86%, 87%, 88%, 89%, 90%, 91%, 92%, 93%, 94%, 95%, 96%, 97%, 98%, 99% or more sequence identity to reference sequence SEQ ID NO:908 and one or more residue differences as compared to SEQ ID NO:908, selected from: 21/42/149, 21/42/149/214/253, 21/42/179/214/244/253, 21/42/253/260/261, 21/149, 21/149/179, 21/149/179/253, 21/149/179/253/260, 21/149/179/253/260/261, 21/149/179/ 261, 21/149/260/261, 21/149/261, 21/179/214/253, 21/179/ 253, 21/179/261, 21/214/253, 21/253, 40, 42/149/179/253/ 260, 42/149/179/260/261, 42/149/214/253, 42/179/253/261, 42/253, 104, 111, 149, 149/179, 149/179/253, 149/179/253/ 260/261, 149/179/260, 149/179/260/261, 149/179/261, 149/ 253, 149/261, 160, 178, 179/214/253, 179/253, 179/253/ 260, 179/253/260/261, 179/253/261, 179/260/261, 179/261, 253, 253/260/261, 253/261, and 255. In some embodiments, the engineered glucose dehydrogenase polypeptide having imine reductase activity comprises an amino acid sequence having at least 80%, 85%, 86%, 87%, 88%, 89%, 90%, 91%, 92%, 93%, 94%, 95%, 96%, 97%, 98%, 99% or more sequence identity to reference sequence SEQ ID NO:908 and one or more residue differences as compared to SEQ ID NO:908, selected from: 21K/42T/149E, 21K/42T/149E/ 214A/253G, 21K/42T/179R/214A/244F/253G, 21K/42T/ 253G/260Q/261E, 21K/149E, 21K/149E/179N, 21K/149E/ 179N/253G, 21K/149E/179N/261E, 21K/149E/179R, 21K/ 149E/179R/253G/260Q/261E, 21K/149E/179R/253R/ 260Q, 21K/149E/260Q/261E, 21K/149E/261E, 21K/179N/ 253G, 21K/179R/214A/253G, 21K/179R/253G, 21K/179R/ 261E, 21K/214A/253G, 21K/253G, 40T, 42T/149E/179N/ 260Q/261E, 42T/149E/179R/253G/260Q, 42T/149E/214A/ 253G, 42T/179N/253G/261E, 42T/253G, 104L, 111L, 149E, 149E/179N/253G, 149E/179N/253G/260Q/261E, 149E/179R, 149E/179R/253G, 149E/179R/260Q, 149E/ 179R/260Q/261E, 149E/179R/261E, 149E/253G, 149E/ 253R, 149E/261E, 160S, 178L, 179N/253G, 179N/253G/ 260Q, 179R/214A/253G, 179R/253G, 179R/253G/260Q, 179R/253G/260Q/261E, 179R/253G/261E, 179R/260Q/ 261E, 179R/261E, 253G, 253G/260Q/261E, 253G/261E, and 255P. In some embodiments, the engineered glucose dehydrogenase polypeptide having imine reductase activity comprises an amino acid sequence having at least 80%, 85%, 86%, 87%, 88%, 89%, 90%, 91%, 92%, 93%, 94%, 95%, 96%, 97%, 98%, 99% or more sequence identity to reference sequence SEQ ID NO:908 and one or more residue differences as compared to SEQ ID NO:908, selected from: R21K/K42T/V149E, R21K/K42T/V149E/ P214A/S253G, R21K/K42T/K179R/P214A/L244F/S253G, R21K/K42T/S253G/R260Q/G261E, R21K/V149E, R21K/ V149E/K179N, R21K/V149E/K179N/S253G, R21K/ V149E/K179N/G261E, R21K/V149E/K179R, R21K/ V149E/K179R/S253G/R260Q/G261E, R21K/V149E/ K179R/S253R/R260Q, R21K/V149E/R260Q/G261E, R21K/V149E/G261E, R21K/K179N/S253G, R21K/ K179R/P214A/S253G, R21K/K179R/S253G, R21K/ K179R/G261E, R21K/P214A/S253G, R21K/S253G, S40T, K42T/V149E/K179N/R260Q/G261E, K42T/V149E/K179R/S253G/R260Q, K42T/V149E/P214A/S253G, K42T/K179N/S253G/G261E, K42T/S253G, M104L, K111L, V149E, V149E/K179N/S253G, V149E/K179N/S253G/R260Q/G261E, V149E/K179R, V149E/K179R/S253G, V149E/K179R/R260Q, V149E/K179R/R260Q/G261E, V149E/K179R/G261E, V149E/S253G, V149E/S253R, V149E/G261E, A160S, S178L, K179N/S253G, K179N/S253G/R260Q, K179R/P214A/S253G, K179R/S253G, K179R/S253G/R260Q, K179R/S253G/R260Q/G261E, K179R/S253G/G261E, K179R/R260Q/G261E, K179R/G261E, S253G, S253G/R260Q/G261E, S253G/G261E, and S255P.

In some embodiments, the engineered glucose dehydrogenase polypeptide having imine reductase activity comprises an amino acid sequence having at least 80%, 85%, 86%, 87%, 88%, 89%, 90%, 91%, 92%, 93%, 94%, 95%, 96%, 97%, 98%, 99% or more sequence identity to reference sequence SEQ ID NO:956 and one or more residue differences as compared to SEQ ID NO:956, selected from: 3, 21/104/160/178/179, 21/104/160/255/258, 21/104/178/179/255, 21/104/178/255/258, 21/104/255, 21/104/255/258, 21/178/179/255/260, 21/255/260, 31, 32, 40, 40/104/178/179, 40/160/178, 46/82/259, 103, 104/149/255/258/260, 104/149/258, 104/160, 104/160/178, 104/160/178/179/255, 104/160/178/179/260, 104/160/178/255/260, 104/160/179, 104/178/179/255/258, 104/178/255/258/260, 104/178/255/260, 104/179, 104/255/260, 104/258/260, 111/149/255/258, 111/149/255/260, 111/160/178/179/255/258/260, 111/160/255/260, 154, 156, 160, 160/178/179, 174, 194, 197, 205, 205/229, 222, 253, 257, 258/260, and 260. In some embodiments, the engineered glucose dehydrogenase polypeptide having imine reductase activity comprises an amino acid sequence having at least 80%, 85%, 86%, 87%, 88%, 89%, 90%, 91%, 92%, 93%, 94%, 95%, 96%, 97%, 98%, 99% or more sequence identity to reference sequence SEQ ID NO:956 and one or more residue differences as compared to SEQ ID NO:956, selected from: 3C, 3T, 21K/104L/160S/178L/179R, 21K/104L/160S/255A/258P, 21K/104L/178R/179R/255F, 21K/104L/178R/255F/258P, 21K/104L/255A, 21K/104L/255F/258P, 21K/178R/179R/255A/260Q, 21K/255A/260Q, 31H, 32M, 40K, 40T/104L/178R/179R, 40T/160S/178L, 46I/82 Q/259N, 103K, 104L/149E/255F/258P/260Q, 104L/149E/258P, 104L/160S, 104L/160S/178A/255A/260Q, 104L/160S/178K/179R/260Q, 104L/160S/178L, 104L/160S/178R/179R/255A, 104L/160S/179R, 104L/178A/179R/255A/258P, 104L/178K/255F/260Q, 104L/178L/255F/258P/260Q, 104L/179R, 104L/255F/260Q, 104L/258P/260Q, 111E/149E/255F/258P, 111E/149E/255F/260Q, 111I/160S/255F/260Q, 111L/160S/178A/179R/255A/258P/260Q, 154H, 154K, 154Q, 154W, 156A, 156T, 160S, 160S/178L/179R, 174A, 194L, 197K, 205I/229S, 205L, 205M, 205T, 222F, 253Y, 257R, 258P/260Q, and 260Q. In some embodiments, the engineered glucose dehydrogenase polypeptide having imine reductase activity comprises an amino acid sequence having at least 80%, 85%, 86%, 87%, 88%, 89%, 90%, 91%, 92%, 93%, 94%, 95%, 96%, 97%, 98%, 99% or more sequence identity to reference sequence SEQ ID NO:956 and one or more residue differences as compared to SEQ ID NO:956, selected from: P3C, P3T, R21K/M104L/A160S/S178L/N179R, R21K/M104L/A160S/S255A/A258P, R21K/M104L/S178R/N179R/S255F, R21K/M104L/S178R/N179R/S255F, R21K/M104L/S255A, R21K/M104L/S255F/A258P, R21K/M104L/S255A, R21K/M104L/S255F/A258P, R21K/S178R/N179R/S255A/R260Q, R21K/S255A/R260Q, Q31H, A32M, S40K, S40T/M104L/S178R/N179R, S40T/A160S/S178L, N46I/E82Q/G259N, E103K, M104L/V149E/S255F/A258P/R260Q, M104L/V149E/A258P, M104L/A160S, M104L/A160S/S178A/S255A/R260Q, M104L/A160S/S178K/N179R/R260Q, M104L/A160S/S178L, M104L/A160S/S178R/N179R/S255A, M104L/A160S/N179R, M104L/S178A/N179R/S255A/A258P, M104L/S178K/S255F/R260Q, M104L/S178L/S255F/A258P/R260Q, M104L/N179R, M104L/S255F/R260Q, M104L/A258P/R260Q, K111E/V149E/S255F/A258P, K111E/V149E/S255F/R260Q, K111I/A160S/S255F/R260Q, K111L/A160S/S178A/N179R/S255A/A258P/R260Q, L154H, L154K, L154Q, L154W, V156A, V156T, A160S, A160S/S178L/N179R, L174A, T194L, A197K, Q205I/A229S, Q205L, Q205M, Q205T, E222F, G253Y, E257R, A258P/R260Q, and R260Q.

In some embodiments, the engineered glucose dehydrogenase polypeptide having imine reductase activity comprises an amino acid sequence having at least 80%, 85%, 86%, 87%, 88%, 89%, 90%, 91%, 92%, 93%, 94%, 95%, 96%, 97%, 98%, 99% or more sequence identity to reference sequence SEQ ID NO:1062 and one or more residue differences as compared to SEQ ID NO:1062, selected from: 3/31/154/205/257, 3/31/205, 3/154/205, 31/55/154/205, 31/55/205, 31/154/205, 31/154/205/257, 31/205, 31/205/222, 40/55/205, 40/154/205, 40/154/205/257, 40/174/205/229, 40/205/229, 54/205/253, 63, 63/149/154/174/178/253, 63/149/154/174/205/253, 63/149/156/178/205/253, 63/149/205, 63/149/205/229/253, 63/149/205/253, 63/154, 63/154/178/205/253, 63/154/205, 63/154/205/229, 63/154/205/229/253, 63/154/205/253, 63/156, 63/156/205, 63/205, 63/205/253, 63/253, 67, 98, 149/154, 149/154/205, 149/156/253, 149/205, 149/205/253, 154, 154/160, 154/160/205, 154/160/205/222/257, 154/160/253, 154/174, 154/174/178/205, 154/174/205/229, 154/205, 154/205/222, 154/205/222/257, 154/205/229, 154/205/253, 154/205/257, 154/229, 154/253, 156/205, 156/205/253, 156/229/253, 160, 160/205, 160/205/229, 194, 205, 205/222, 205/229, 205/229/253, 205/253, 208, 226, and 253. In some embodiments, the engineered glucose dehydrogenase polypeptide having imine reductase activity comprises an amino acid sequence having at least 80%, 85%, 86%, 87%, 88%, 89%, 90%, 91%, 92%, 93%, 94%, 95%, 96%, 97%, 98%, 99% or more sequence identity to reference sequence SEQ ID NO:1062 and one or more residue differences as compared to SEQ ID NO:1062, selected from: 3C/31H/154K/205M/257R, 3L/154W/205L, 3T/31H/205L, 31H/55W/154K/205T, 31H/55W/154Q/205T, 31H/55W/154W/205T, 31H/55W/205I, 31H/154Q/205L, 31H/154W/205I, 31H/154W/205I/257R, 31H/154W/205L, 31H/154W/205L/257R, 31H/205I/222Q, 31H/205L, 40K/55W/205L, 40T/154Q/205T, 40T/154Q/205T/257R, 40T/174A/205I/229S, 40T/205T/229S, 54E/205M/253Y, 63M, 63M/149E/154K/174A/178K/253Y, 63M/149E/154W/174A/205T/253Y, 63M/149E/156T/178K/205L/253Y, 63M/149E/205L, 63M/149E/205L/229S/253Y, 63M/149E/205L/253Y, 63M/149E/205T/253Y, 63M/154H/178K/205I/253Y, 63M/154H/205L/229S, 63M/154K/205L, 63M/154K/205T/253Y, 63M/154Q/205I/229S/253Y, 63M/154W, 63M/154W/178K/205L/253Y, 63M/154W/205M, 63M/154W/205T, 63M/156A, 63M/156A/205T, 63M/205L, 63M/205M, 63M/205M/253Y, 63M/205T, 63M/205T/253Y, 63M/253Y, 67S, 98Q, 149E/154S/205L, 149E/154W, 149E/156A/253Y, 149E/205M, 149E/205M/253Y, 149E/205T, 149E/205T/253D, 154H, 154H/174A, 154H/205L/253Y, 154H/205T, 154K, 154K/160A, 154K/160A/205L, 154K/160A/205M, 154K/160A/253Y, 154K/174A/205/229S, 154K/205I, 154K/205M, 154K/253Y, 154Q/160A/205L/222F/257R, 154Q/205I/253Y, 154Q/205L/222R/257R, 154Q/205M/257R, 154W, 154W/174A/178K/205T, 154W/

205I, 154W/205I/222G, 154W/205I/257R, 154W/205L, 154W/205L/222R, 154W/205M, 154W/205T, 154W/205T/222F/257R, 154W/205T/222Y, 154W/205T/229S, 154W/205T/253Y, 154W/229S, 154W/253Y, 156A/205M/253Y, 156A/229S/253Y, 156T/205T, 160A, 160A/205L, 160A/205L/229S, 160A/205M/229S, 194H, 205L, 205L/222G, 205M, 205T, 205T/222Y, 205T/229S, 205T/229S/253Y, 205T/253Y, 208L, 208R, 208T, 226C, and 253Y. In some embodiments, the engineered glucose dehydrogenase polypeptide having imine reductase activity comprises an amino acid sequence having at least 80%, 85%, 86%, 87%, 88%, 89%, 90%, 91%, 92%, 93%, 94%, 95%, 96%, 97%, 98%, 99% or more sequence identity to reference sequence SEQ ID NO:1062 and one or more residue differences as compared to SEQ ID NO:1062, selected from: P3C/Q31H/L154K/Q205M/E257R, P3L/L154W/Q205L, P3T/Q31H/Q205L, Q31H/A55W/L154K/Q205T, Q31H/A55W/L154Q/Q205T, Q31H/A55W/L154W/Q205T, Q31H/A55W/Q205I, Q31H/L154Q/Q205L, Q31H/L154W/Q205I, Q31H/L154W/Q205I/E257R, Q31H/L154W/Q205L, Q31H/L154W/Q205L/E257R, Q31H/Q205I/E222Q, Q31H/Q205L, S40K/A55W/Q205L, S40T/L154Q/Q205T, S40T/L154Q/Q205T/E257R, S40T/L174A/Q205I/A229S, S40T/Q205T/A229S, K54E/Q205M/G253Y, Q63M, Q63M/V149E/L154K/L174A/S178K/G253Y, Q63M/V149E/L154W/L174A/Q205T/G253Y, Q63M/V149E/V156T/S178K/Q205L/G253Y, Q63M/V149E/Q205L, Q63M/V149E/Q205L/A229S/G253Y, Q63M/V149E/Q205L/G253Y, Q63M/V149E/Q205T/G253Y, Q63M/L154H/S178K/Q205I/G253Y, Q63M/L154H/Q205L/A229S, Q63M/L154K/Q205L, Q63M/L154K/Q205T/G253Y, Q63M/L154Q/Q205I/A229S/G253Y, Q63M/L154W, Q63M/L154W/S178K/Q205L/G253Y, Q63M/L154W/Q205M, Q63M/L154W/Q205T, Q63M/V156A, Q63M/V156A/Q205T, Q63M/Q205L, Q63M/Q205M, Q63M/Q205M/G253Y, Q63M/Q205T, Q63M/Q205T/G253Y, Q63M/G253Y, T67S, P98Q, V149E/L154S/Q205L, V149E/L154W, V149E/V156A/G253Y, V149E/Q205M, V149E/Q205M/G253Y, V149E/Q205T, V149E/Q205T/G253D, L154H, L154H/L174A, L154H/Q205L/G253Y, L154H/Q205T, L154K, L154K/S160A, L154K/S160A/Q205L, L154K/S160A/Q205M, L154K/S160A/G253Y, L154K/L174A/Q205L/A229S, L154K/Q205I, L154K/Q205M, L154K/G253Y, L154Q/S160A/Q205L/E222F/E257R, L154Q/Q205I/G253Y, L154Q/Q205L/E222R/E257R, L154Q/Q205M/E257R, L154W, L154W/L174A/S178K/Q205T, L154W/Q205I, L154W/Q205I/E222G, L154W/Q205I/E257R, L154W/Q205L, L154W/Q205L/E222R, L154W/Q205M, L154W/Q205T, L154W/Q205T/E222F/E257R, L154W/Q205T/E222Y, L154W/Q205T/A229S, L154W/Q205T/G253Y, L154W/A229S, L154W/G253Y, V156A/Q205M/G253Y, V156A/A229S/G253Y, V156T/Q205T, S160A, S160A/Q205L, S160A/Q205L/A229S, S160A/Q205M/A229S, T194H, Q205L, Q205L/E222G, Q205M, Q205T, Q205T/E222Y, Q205T/A229S, Q205T/A229S/G253Y, Q205T/G253Y, D208L, D208R, D208T, A226C, and G253Y.

As will be appreciated by the skilled artisan, in some embodiments, one or a combination of residue differences above that is selected can be kept constant (i.e., maintained) in the engineered glucose dehydrogenase as a core feature, and additional residue differences at other residue positions incorporated into the sequence to generate additional engineered glucose dehydrogenase polypeptides with improved properties. Accordingly, it is to be understood for any engineered glucose dehydrogenase containing one or a subset of the residue differences above, the present invention contemplates other engineered glucose dehydrogenases that comprise the one or subset of the residue differences, and additionally one or more residue differences at the other residue positions disclosed herein.

As noted above, the engineered glucose dehydrogenase polypeptides having imine reductase activity are also capable of converting substrates (e.g., Compound (2) and Compound (3)) to products (e.g., Compound (1)). In some embodiments, the engineered glucose dehydrogenase polypeptide is capable of converting the substrate compounds to the product compound with at least 1.2 fold, 1.5 fold, 2 fold, 3 fold, 4 fold, 5 fold, 10 fold, 20 fold, 30 fold, 40 fold, 50 fold, 60 fold, 70 fold, 80 fold, 90 fold, 100 fold, or more activity relative to the activity of the reference polypeptide of SEQ ID NO:4, 14, 34, 112, 736, 908, 956, and/or 1062.

In some embodiments, the engineered glucose dehydrogenase polypeptide capable of converting the substrate compounds to the product compounds with at least 2 fold the activity relative to SEQ ID NO: 4, 14, 34, 112, 736, 908, 956, and/or 1062, comprises an amino acid sequence selected from: the even-numbered sequences in SEQ ID NOs:6-1384.

In some embodiments, the engineered glucose dehydrogenase has an amino acid sequence comprising one or more residue differences as compared to SEQ ID NO: 4, 14, 34, 112, 736, 908, 956, and/or 1062, increases expression of the engineered glucose dehydrogenase activity in a bacterial host cell, particularly in $E.\ coli$.

In some embodiments, the engineered glucose dehydrogenase polypeptide with improved properties has an amino acid sequence comprising a sequence selected from the even-numbered sequences in the range of SEQ ID NOs: 6-1384.

In some embodiments, the engineered glucose dehydrogenase polypeptide having imine reductase activity, comprises an amino acid sequence having at least 80%, 85%, 86%, 87%, 88%, 89%, 90%, 91%, 92%, 93%, 94%, 95%, 96%, 97%, 98%, or 99% identity to one of the even-numbered sequences in the range of SEQ ID NOs:6-1384, and the amino acid residue differences as compared to SEQ ID NO: 4, 14, 34, 112, 736, 908, 956, and/or 1062, present in any one of the even-numbered sequences in the range of SEQ ID NOs:6-1384, as provided in the Examples.

In addition to the residue positions specified above, any of the engineered glucose dehydrogenase polypeptides disclosed herein can further comprise other residue differences relative to SEQ ID NO: 4, 14, 34, 112, 736, 908, 956, and/or 1062, at other residue positions (i.e., residue positions other than those included herein). Residue differences at these other residue positions can provide for additional variations in the amino acid sequence without adversely affecting the ability of the polypeptide to carry out the conversion of substrate to product. Accordingly, in some embodiments, in addition to the amino acid residue differences present in any one of the engineered glucose dehydrogenase polypeptides selected from the even-numbered sequences in the range of SEQ ID NOs: 6-1384, the sequence can further comprise 1-2, 1-3, 1-4, 1-5, 1-6, 1-7, 1-8, 1-9, 1-10, 1-11, 1-12, 1-14, 1-15, 1-16, 1-18, 1-20, 1-22, 1-24, 1-26, 1-30, 1-35, 1-40, 1-45, or 1-50 residue differences at other amino acid residue positions as compared to the SEQ ID NO: 4, 14, 34, 112, 736, 908, 956, and/or 1062. In some embodiments, the number of amino acid residue differences as compared to the reference sequence can be 1, 2, 3, 4, 5, 6, 7, 8, 9, 10, 11, 12, 13, 14, 15, 16, 17, 18, 19, 20, 21, 22, 23, 24, 25, 30, 30, 35, 40, 45 or 50 residue positions. In some embodiments, the number of amino acid residue differences as compared to the reference sequence can be 1, 2, 3, 4, 5, 6, 7, 8, 9, 10, 11, 12, 13, 14, 15, 16, 18, 20, 21, 22, 23, 24, or 25 residue positions. The residue differences at these other positions can be conservative changes or non-conservative changes. In some embodiments, the residue differences can comprise conservative substitutions and non-conservative substitutions as compared to the glucose dehydrogenase polypeptide of SEQ ID NOs: 4, 14, 34, 112, 736, 908, 956, and/or 1062.

In some embodiments, the present invention also provides engineered polypeptides that comprise a fragment of any of the engineered glucose dehydrogenase polypeptides described herein that retains the functional activity and/or improved property of that engineered glucose dehydrogenase. Accordingly, in some embodiments, the present invention provides a polypeptide fragment capable of converting substrate to product under suitable reaction conditions, wherein the fragment comprises at least about 90%, 95%, 96%, 97%, 98%, or 99% of a full-length amino acid sequence of an engineered glucose dehydrogenase polypeptide of the present invention, such as an exemplary engineered glucose dehydrogenase polypeptide selected from the even-numbered sequences in the range of SEQ ID NOs:6-1384. In some embodiments, the engineered glucose dehydrogenase polypeptide can have an amino acid sequence comprising a deletion in any one of the engineered glucose dehydrogenase polypeptide sequences described herein, such as the exemplary engineered polypeptides of the even-numbered sequences in the range of SEQ ID NOs:6-1384.

Thus, for each and every embodiment of the engineered glucose dehydrogenase polypeptides of the invention, the amino acid sequence can comprise deletions of one or more amino acids, 2 or more amino acids, 3 or more amino acids, 4 or more amino acids, 5 or more amino acids, 6 or more amino acids, 8 or more amino acids, 10 or more amino acids, 15 or more amino acids, or 20 or more amino acids, up to 10% of the total number of amino acids, up to 20% of the total number of amino acids, or up to 30% of the total number of amino acids of the glucose dehydrogenase polypeptides, where the associated functional activity and/or improved properties of the engineered glucose dehydrogenase described herein are maintained. In some embodiments, the deletions can comprise 1-2, 1-3, 1-4, 1-5, 1-6, 1-7, 1-8, 1-9, 1-10, 1-15, 1-20, 1-21, 1-22, 1-23, 1-24, 1-25, 1-30, 1-35, 1-40, 1-45, or 1-50 amino acid residues. In some embodiments, the number of deletions can be 1, 2, 3, 4, 5, 6, 7, 8, 9, 10, 11, 12, 13, 14, 15, 16, 17, 18, 19, 20, 21, 22, 23, 24, 25, 30, 30, 35, 40, 45, or 50 amino acid residues. In some embodiments, the deletions can comprise deletions of 1, 2, 3, 4, 5, 6, 7, 8, 9, 10, 11, 12, 13, 14, 15, 16, 18, 20, 21, 22, 23, 24, or 25 amino acid residues.

In some embodiments, the engineered glucose dehydrogenase polypeptide herein can have an amino acid sequence comprising an insertion as compared to any one of the engineered glucose dehydrogenase polypeptides described herein, such as the exemplary engineered polypeptides of the even-numbered sequences in the range of SEQ ID NOs:6-1384. Thus, for each and every embodiment of the glucose dehydrogenase polypeptides of the invention, the insertions can comprise one or more amino acids, 2 or more amino acids, 3 or more amino acids, 4 or more amino acids, 5 or more amino acids, 6 or more amino acids, 8 or more amino acids, 10 or more amino acids, 15 or more amino acids, 20 or more amino acids, 30 or more amino acids, 40 or more amino acids, or 50 or more amino acids, where the associated functional activity and/or improved properties of the engineered glucose dehydrogenase described herein is maintained. The insertions can be to amino or carboxy terminus, or internal portions of the glucose dehydrogenase polypeptide.

In some embodiments, the engineered glucose dehydrogenase polypeptide herein can have an amino acid sequence comprising a sequence selected from the even-numbered sequences in the range of SEQ ID NOs:6-1384, and optionally one or several (e.g., up to 3, 4, 5, or up to 10) amino acid residue deletions, insertions and/or substitutions. In some embodiments, the amino acid sequence has optionally 1-2, 1-3, 1-4, 1-5, 1-6, 1-7, 1-8, 1-9, 1-10, 1-15, 1-20, 1-21, 1-22, 1-23, 1-24, 1-25, 1-30, 1-35, 1-40, 1-45, or 1-50 amino acid residue deletions, insertions and/or substitutions. In some embodiments, the number of amino acid sequence has optionally 1, 2, 3, 4, 5, 6, 7, 8, 9, 10, 11, 12, 13, 14, 15, 16, 17, 18, 19, 20, 21, 22, 23, 24, 25, 30, 30, 35, 40, 45, or 50 amino acid residue deletions, insertions and/or substitutions. In some embodiments, the amino acid sequence has optionally 1, 2, 3, 4, 5, 6, 7, 8, 9, 10, 11, 12, 13, 14, 15, 16, 18, 20, 21, 22, 23, 24, or 25 amino acid residue deletions, insertions and/or substitutions. In some embodiments, the substitutions can be conservative or non-conservative substitutions.

In the above embodiments, the suitable reaction conditions for the engineered polypeptides are provided in Tables 5.1, 6.1, 7.1, 8.1, 9.1, 10.1, 11.1 and 12.1, and as described in the Examples herein.

In some embodiments, the polypeptides of the present invention are fusion polypeptides in which the engineered polypeptides are fused to other polypeptides, such as, by way of example and not limitation, antibody tags (e.g., myc epitope), purification sequences (e.g., His tags for binding to metals), and cell localization signals (e.g., secretion signals). Thus, the engineered polypeptides described herein can be used with or without fusions to other polypeptides.

It is to be understood that the polypeptides described herein are not restricted to the genetically encoded amino acids. In addition to the genetically encoded amino acids, the polypeptides described herein may be comprised, either in whole or in part, of naturally occurring and/or synthetic non-encoded amino acids. Certain commonly encountered non-encoded amino acids of which the polypeptides described herein may be comprised include, but are not limited to: the D-stereomers of the genetically-encoded amino acids; 2,3-diaminopropionic acid (Dpr); α-aminoisobutyric acid (Aib); s-aminohexanoic acid (Aha); δ-aminovaleric acid (Ava); N-methylglycine or sarcosine (MeGly or Sar); ornithine (Orn); citrulline (Cit); t-butylalanine (Bua); t-butylglycine (Bug); N-methylisoleucine (MeIle); phenylglycine (Phg); cyclohexylalanine (Cha); norleucine (Nle); naphthylalanine (Nal); 2-chlorophenylalanine (Ocf); 3-chlorophenylalanine (Mcf); 4-chlorophenylalanine (Pcf); 2-fluorophenylalanine (Off); 3-fluorophenylalanine (Mff); 4-fluorophenylalanine (Pff); 2-bromophenylalanine (Obf); 3-bromophenylalanine (Mbf); 4-bromophenylalanine (Pbf); 2-methylphenylalanine (Omf); 3-methylphenylalanine (Mmf); 4-methylphenylalanine (Pmf); 2-nitrophenylalanine (Onf); 3-nitrophenylalanine (Mnf); 4-nitrophenylalanine (Pnf); 2-cyanophenylalanine (Ocf); 3-cyanophenylalanine (Mcf); 4-cyanophenylalanine (Pcf); 2-trifluoromethylphenylalanine (Otf); 3-trifluoromethylphenylalanine (Mtf); 4-trifluoromethylphenylalanine (Ptf); 4-aminophenylalanine (Paf); 4-iodophenylalanine (Pif); 4-aminomethylphenylalanine (Pamf); 2,4-dichlorophenylalanine (Opef); 3,4-dichlorophenylalanine (Mpcf); 2,4-difluorophenylalanine (Opff); 3,4-difluorophenylalanine (Mpff); pyrid-2-ylalanine (2pAla); pyrid-3-ylalanine (3pAla); pyrid-4-ylalanine (4pAla); naphth-1-ylalanine (1nAla); naphth-2-ylalanine (2nAla); thiazolylalanine (taAla); benzothienylalanine (bAla); thienylalanine (tAla); furylalanine (fAla); homophenylalanine (hPhe); homotyrosine (hTyr); homotryptophan (hTrp); pentafluorophenylalanine (5ff); styrylkalanine (sAla); authrylalanine (aAla); 3,3-diphenylalanine (Dfa); 3-amino-5-phenypentanoic acid (Afp); penicillamine (Pen); 1,2,3,4-tetrahydroisoquinoline-3-carboxylic acid (Tic); β-2-thienylalanine (Thi); methionine sulfoxide (Mso); N(w)-nitroarginine (nArg); homolysine (hLys); phosphonomethylphenylalanine (pmPhe); phosphoserine (pSer); phosphothreonine (pThr); homoaspartic acid (hAsp); homoglutanic acid (hGlu); 1-aminocyclopent-(2 or 3)-ene-4 carboxylic acid; pipecolic acid (PA), azetidine-3-carboxylic acid (ACA); 1-aminocyclopentane-3-carboxylic acid; allylglycine (aGly); propargylglycine (pgGly); homoalanine (hAla); norvaline (nVal); homoleucine (hLeu), homovaline (hVal); homoisoleucine (hIle); homoarginine (hArg); N-acetyl lysine (AcLys); 2,4-diaminobutyric acid (Dbu); 2,3-diaminobutyric acid (Dab); N-methylvaline (MeVal); homocysteine (hCys); homoserine (hSer); hydroxyproline (Hyp) and homoproline (hPro). Additional non-encoded amino acids of which the polypeptides described herein may be comprised will be apparent to those of skill in the art (See e.g., the various amino acids provided in Fasman, *CRC Practical Handbook of Biochemistry and Molecular Biology*, CRC Press, Boca Raton, FL, pp. 3-70 [1989], and the references cited therein, all of which are incorporated by reference). These amino acids may be in either the L- or D-configuration.

Those of skill in the art will recognize that amino acids or residues bearing side chain protecting groups may also comprise the polypeptides described herein. Non-limiting examples of such protected amino acids, which in this case belong to the aromatic category, include (protecting groups listed in parentheses), but are not limited to: Arg(tos), Cys(methylbenzyl), Cys (nitropyridinesulfenyl), Glu(δ-benzylester), Gln(xanthyl), Asn(N-δ-xanthyl), His(bom), His (benzyl), His(tos), Lys(fmoc), Lys(tos), Ser(O-benzyl), Thr (O-benzyl) and Tyr(O-benzyl).

Non-encoding amino acids that are conformationally constrained of which the polypeptides described herein may be composed include, but are not limited to, N-methyl amino acids (L-configuration); 1-aminocyclopent-(2 or 3)-ene-4-carboxylic acid; pipecolic acid; azetidine-3-carboxylic acid; homoproline (hPro); and 1-aminocyclopentane-3-carboxylic acid.

In some embodiments, the engineered polypeptides can be in various forms, for example, such as an isolated preparation, as a substantially purified enzyme, whole cells transformed with gene(s) encoding the enzyme, and/or as cell extracts and/or lysates of such cells. The enzymes can be lyophilized, spray-dried, precipitated or be in the form of a crude paste, as further discussed below.

In some embodiments, the engineered polypeptides can be in the form of a biocatalytic composition. In some embodiments, the biocatalytic composition comprises (a) a means for conversion of a carbonyl compound and an amine compound to a chiral secondary or tertiary amine by contact with a glucose dehydrogenase polypeptide and (b) a suitable cofactor. Is some embodiments, the biocatalytic composition comprises a chiral secondary or tertiary amine that is acyclic, comprises one or more functional groups, or comprises alkyl chains, including branched chains. In some embodiments, the biocatalytic composition comprises a glucose dehydrogenase that has imine reductase activity. In some further embodiments, the biocatalytic composition comprises a glucose dehydrogenase with imine reductase activity that additionally catalyzes one or more reactions in a multistep reaction pathway. In some embodiments, the biocatalytic composition comprises a NAD+ (nicotinamide adenine dinucleotide) or NADP+ (nicotinamide adenine dinucleotide phospate) cofactor.

In some embodiments, the engineered polypeptides can be provided on a solid support, such as a membrane, resin, solid carrier, or other solid phase material. A solid support can be composed of organic polymers such as polystyrene, polyethylene, polypropylene, polyfluoroethylene, polyethyleneoxy, and polyacrylamide, as well as co-polymers and grafts thereof. A solid support can also be inorganic, such as glass, silica, controlled pore glass (CPG), reverse phase silica or metal, such as gold or platinum. The configuration of a solid support can be in the form of beads, spheres, particles, granules, a gel, a membrane or a surface. Surfaces can be planar, substantially planar, or non-planar. Solid supports can be porous or non-porous, and can have swelling or non-swelling characteristics. A solid support can be configured in the form of a well, depression, or other container, vessel, feature, or location.

In some embodiments, the engineered glucose dehydrogenase polypeptides having imine reductase activity of the present invention can be immobilized on a solid support such that they retain their improved activity, and/or other improved properties relative to the reference polypeptide of SEQ ID NO: 4, 14, 34, 112, 736, 908, 956, and/or 1062. In such embodiments, the immobilized polypeptides can facilitate the biocatalytic conversion of the substrate compounds or other suitable substrates to the product and after the reaction is complete are easily retained (e.g., by retaining beads on which polypeptide is immobilized) and then reused or recycled in subsequent reactions. Such immobilized enzyme processes allow for further efficiency and cost reduction. Accordingly, it is further contemplated that any of the methods of using the glucose dehydrogenase polypeptides of the present invention can be carried out using the same glucose dehydrogenase polypeptides bound or immobilized on a solid support.

Methods of enzyme immobilization are well-known in the art. The engineered polypeptides can be bound non-covalently or covalently. Various methods for conjugation and immobilization of enzymes to solid supports (e.g., resins, membranes, beads, glass, etc.) are well known in the art (See e.g., Yi et al., Proc. Biochem., 42(5): 895-898 [2007]; Martin et al., Appl. Microbiol. Biotechnol., 76(4): 843-851 [2007]; Koszelewski et al., J. Mol. Cat. B: Enzymatic, 63: 39-44 [2010]; Truppo et al., Org. Proc. Res. Dev., published online: dx.doi.org/10.1021/op200157c; Hermanson, *Bioconjugate Techniques*, 2nd ed., Academic Press, Cambridge, MA [2008]; Mateo et al., Biotechnol. Prog., 18(3):629-34 [2002]; and "Bioconjugation Protocols: Strategies and Methods," In *Methods in Molecular Biology*, Niemeyer (ed.), Humana Press, New York, NY [2004]; the disclosures of each which are incorporated by reference herein). Solid supports useful for immobilizing the engineered glucose dehydrogenases of the present invention include but are not limited to beads or resins comprising polymethacrylate with epoxide functional groups, polymethacrylate with amino epoxide functional groups, styrene/DVB copolymer or polymethacrylate with octadecyl functional groups. Exemplary solid supports useful for immobilizing the engineered glucose dehydrogenase polypeptides of the present invention include, but are not limited to, chitosan beads, Eupergit C, and SEPABEADs (Mitsubishi), including the following different types of SEPABEAD: EC-EP, EC-HFA/S, EXA252, EXE119 and EXE120.

In some embodiments, the polypeptides described herein are provided in the form of kits. The enzymes in the kits may be present individually or as a plurality of enzymes. The kits can further include reagents for carrying out the enzymatic reactions, substrates for assessing the activity of enzymes, as well as reagents for detecting the products. The kits can also include reagent dispensers and instructions for use of the kits.

In some embodiments, the kits of the present invention include arrays comprising a plurality of different glucose dehydrogenase polypeptides at different addressable position, wherein the different polypeptides are different variants of a reference sequence each having at least one different improved enzyme property. In some embodiments, a plurality of polypeptides immobilized on solid supports are configured on an array at various locations, addressable for robotic delivery of reagents, or by detection methods and/or instruments. The array can be used to test a variety of substrate compounds for conversion by the polypeptides. Such arrays comprising a plurality of engineered polypeptides and methods of their use are known in the art (See e.g., WO2009/008908A2).

Polynucleotides Encoding Engineered Glucose Dehydrogenases, Expression Vectors and Host Cells In another aspect, the present invention provides polynucleotides encoding the engineered glucose dehydrogenase polypeptides described herein. The polynucleotides may be operatively linked to one or more heterologous regulatory sequences that control gene expression to create a recombinant polynucleotide capable of expressing the polypeptide. Expression constructs containing a heterologous polynucleotide encoding the engineered glucose dehydrogenase are introduced into appropriate host cells to express the corresponding glucose dehydrogenase polypeptide.

As will be apparent to the skilled artisan, availability of a protein sequence and the knowledge of the codons corresponding to the various amino acids provide a description of all the polynucleotides capable of encoding the subject polypeptides. The degeneracy of the genetic code, where the same amino acids are encoded by alternative or synonymous codons, allows an extremely large number of nucleic acids to be made, all of which encode the improved glucose dehydrogenase enzymes. Thus, having knowledge of a particular amino acid sequence, those skilled in the art could make any number of different nucleic acids by simply modifying the sequence of one or more codons in a way which does not change the amino acid sequence of the protein. In this regard, the present invention specifically contemplates each and every possible variation of polynucleotides that could be made encoding the polypeptides described herein by selecting combinations based on the possible codon choices, and all such variations are to be considered specifically disclosed for any polypeptide described herein, including the amino acid sequences presented in Tables 5.1, 6.1, 7.1, 8.1, 9.1, 10.1, 11.1 and 12.1, and disclosed in the sequence listing incorporated by reference herein as the even-numbered sequences in the range of SEQ ID NOs:6-1384.

In various embodiments, the codons are preferably selected to fit the host cell in which the protein is being produced. For example, preferred codons used in bacteria are used to express the gene in bacteria; preferred codons used in yeast are used for expression in yeast; and preferred codons used in mammals are used for expression in mammalian cells. In some embodiments, all codons need not be replaced to optimize the codon usage of the glucose dehydrogenases since the natural sequence will comprise preferred codons and because use of preferred codons may not be required for all amino acid residues. Consequently, codon optimized polynucleotides encoding the glucose dehydrogenase enzymes may contain preferred codons at about 40%, 50%, 60%, 70%, 80%, or greater than 90% of codon positions of the full length coding region.

In some embodiments, the polynucleotide comprises a codon optimized nucleotide sequence encoding the glucose dehydrogenase polypeptide amino acid sequence, as represented by SEQ ID NO:4, 14, 34, 112, 736, 908, 956, and/or 1062. In some embodiments, the polynucleotide has a nucleic acid sequence comprising at least 80%, 85%, 90%, 91%, 92%, 93%, 94%, 95%, 96%, 97%, 98%, 99% or more identity to the codon optimized nucleic acid sequences encoding the even-numbered sequences in the range of SEQ ID NOs:6-1384. In some embodiments, the polynucleotide has a nucleic acid sequence comprising at least 80%, 85%, 90%, 91%, 92%, 93%, 94%, 95%, 96%, 97%, 98%, 99% or more identity to the codon optimized nucleic acid sequences in the odd-numbered sequences in the range of SEQ ID NOs:5-1383. In some embodiments, the codon optimized sequences of the odd-numbered sequences in the range of SEQ ID NOs:5-1383, enhance expression of the encoded glucose dehydrogenase, providing preparations of enzyme capable of converting substrate to product.

In some embodiments, the polynucleotides are capable of hybridizing under highly stringent conditions to a reference sequence selected from the odd-numbered sequences in SEQ ID NOs:5-1383, or a complement thereof, and encode a glucose dehydrogenase polypeptide having imine reductase activity.

In some embodiments, as described above, the polynucleotide encodes an engineered glucose dehydrogenase polypeptide having imine reductase activity with improved properties as compared to SEQ ID NO:4, 14, 34, 112, 736, 908, 956, and/or 1062, wherein the polypeptide comprises an amino acid sequence having at least 80%, 85%, 86%, 87%, 88%, 89%, 90%, 91%, 92%, 93%, 94%, 95%, 96%, 97%, 98%, 99% or more identity to a reference sequence selected from SEQ ID NO: 4, 14, 34, 112, 736, 908, 956, and/or 1062, and one or more residue differences as compared to SEQ ID NO:4, 14, 34, 112, 736, 908, 956, and/or 1062, wherein the sequence is selected from the even-numbered sequences in the range of SEQ ID NOs:6-1384. In some embodiments, the reference amino acid sequence is selected from the even-numbered sequences in the range of SEQ ID NOs:6-1384. In some embodiments, the reference amino acid sequence is SEQ ID NO:4, while in some other embodiments, the reference sequence is SEQ ID NO:14, while in some other embodiments, the reference sequence is SEQ ID NO:34, while in some other embodiments, the reference sequence is SEQ ID NO:112, while in some other embodiments, the reference sequence is SEQ ID NO:736, while in some other embodiments, the reference sequence is SEQ ID NO:908, while in some other embodiments, the reference sequence is SEQ ID NO:956, while in some other embodiments, the reference sequence is SEQ ID NO:1062, and in still some other embodiments, the reference sequence is SEQ ID NO:1172.

In some embodiments, the polynucleotide encodes a glucose dehydrogenase polypeptide capable of converting one or more substrates to product with improved properties as compared to SEQ ID NO: 4, 14, 34, 112, 736, 908, 956, and/or 1062, wherein the polypeptide comprises an amino acid sequence having at least 80%, 85%, 86%, 87%, 88%, 89%, 90%, 91%, 92%, 93%, 94%, 95%, 96%, 97%, 98%, 99% or more sequence identity to reference sequence SEQ ID NO: 4, 14, 34, 112, 736, 908, 956, and/or 1062.

In some embodiments, the polynucleotide encoding the engineered glucose dehydrogenase comprises a polynucleotide sequence selected from the odd-numbered sequences in the range of SEQ ID NOs:5-1383.

In some embodiments, the polynucleotides are capable of hybridizing under highly stringent conditions to a reference polynucleotide sequence selected from the odd-numbered sequences in the range of SEQ ID NOs:5-1383, or a complement thereof, and encode a glucose dehydrogenase polypeptide having imine reductase activity with one or more of the improved properties described herein. In some embodiments, the polynucleotide capable of hybridizing under highly stringent conditions encodes a glucose dehydrogenase polypeptide comprising an amino acid sequence having at least 80%, 85%, 86%, 87%, 88%, 89%, 90%, 91%, 92%, 93%, 94%, 95%, 96%, 97%, 98%, 99% or more identity to SEQ ID NO:4, that has an amino acid sequence comprising one or more residue differences as compared to SEQ ID NO:4, at residue positions selected from: 96, 96/118, 147, 155, 155/253, 195, 200, and 256.

In some embodiments, the polynucleotides are capable of hybridizing under highly stringent conditions to a reference polynucleotide sequence selected from the odd-numbered sequences in the range of SEQ ID NOs:5-1383, or a complement thereof, and encode a glucose dehydrogenase polypeptide having imine reductase activity with one or more of the improved properties described herein. In some embodiments, the polynucleotide capable of hybridizing under highly stringent conditions encodes a glucose dehydrogenase polypeptide comprising an amino acid sequence having at least 80%, 85%, 86%, 87%, 88%, 89%, 90%, 91%, 92%, 93%, 94%, 95%, 96%, 97%, 98%, 99% or more identity to SEQ ID NO:14, that has an amino acid sequence comprising one or more residue differences as compared to SEQ ID NO:14, at residue positions selected from: 17, 95/96, 95/96/118, 95/96/118/156/200/253, 95/96/147, 95/96/147/200, 95/96/147/200/253, 95/96/155/156, 95/96/155/195/200, 95/96/159/195/253, 95/155/156, 95/155/159/200, 95/155/200, 96, 96/147/195/200/253, 96/155, 96/155/159, 96/155/159/195, 96/155/159/200, 96/156/159/195, 96/156/159/195/200, 96/195, 147, 147/155, 147/155/156, 147/155/156/200, 147/155/159, 147/195/200/253, 155, 155/156, 155/156/195/200/253, 155/159/200, and 253.

In some embodiments, the polynucleotide capable of hybridizing under highly stringent conditions encodes an engineered glucose dehydrogenase polypeptide having imine reductase activity with improved properties comprising an amino acid sequence having at least 80%, 85%, 86%, 87%, 88%, 89%, 90%, 91%, 92%, 93%, 94%, 95%, 96%, 97%, 98%, 99% or more identity to SEQ ID NO:34, and one or more residue differences as compared to SEQ ID NO:34 at residue positions selected from: 17, 17/21, 17/21/42, 17/21/42/155/260, 17/21/49, 17/21/49/51, 17/21/49/51/96, 17/21/49/51/260, 17/21/49/96/155/260, 17/21/49/260, 17/21/51/96, 17/21/51/195, 17/21/96, 17/21/96/155, 17/21/96/195/260, 17/21/96/253, 17/21/147/155/253, 17/21/155/253, 17/21/195, 17/21/253, 17/42, 17/42/49/195/260, 17/42/96, 17/44, 17/44/47/51/96, 17/44/47/51/96/114/147/195/199/253, 17/44/47/51/96/114/147/199, 17/44/47/51/96/114/195/199, 17/44/47/51/96/147/253, 17/44/47/51/178/195, 17/44/47/195/199, 17/44/51/114/195/253, 17/46/47/51/96/147, 17/46/47/51/96/195/253, 17/46/47/51/155, 17/46/47/51/155/195/199, 17/46/47/96/195, 17/46/47/178, 17/46/96/253, 17/47, 17/47/51, 17/47/51/96/114/147/195, 17/47/51/96/114/155/178/253, 17/47/51/96/195, 17/47/51/96/195/199, 17/47/96/114/155/253, 17/47/96/147/155/195/199, 17/47/96/147/195/199/253, 17/47/96/155, 17/47/96/195/199, 17/47/114, 17/47/114/155/195/199/253, 17/47/147/195/199/253, 17/49, 17/49/51, 17/49/51/96/195/253, 17/49/51/155/253, 17/49/51/155/253/260, 17/49/51/155/260, 17/49/51/253, 17/49/96, 17/49/96/155/253, 17/49/96/195, 17/49/260, 17/51, 17/51/96/114, 17/51/96/155/178, 17/51/96/155/195/199/253, 17/51/96/155/199, 17/51/96/155/253, 17/51/96/178/195/199, 17/51/96/195, 17/51/96/260, 17/51/114, 17/51/114/253, 17/51/147, 17/51/155/195, 17/51/178/195/253, 17/51/253, 17/96, 17/96/114/147/155, 17/96/114/147/155/178/195/199, 17/96/147, 17/96/147/155, 17/96/155/178, 17/96/155/178/253, 17/96/155/195, 17/96/155/195/199, 17/96/178, 17/96/178/195, 17/96/195, 17/96/195/199, 17/96/195/199/253, 17/96/253, 17/114, 17/114/253, 17/147/155/253, 17/147/178, 17/147/199, 17/155, 17/155/178, 17/155/178/195, 17/155/195, 17/155/195/253, 17/155/199, 17/155/253, 17/178, 17/178/195/253, 17/195, 17/195/199, 17/195/199/253, 17/195/253, 17/199, 17/253, 17/260, 21/49/51, 21/49/96/195, 21/49/96/253, 21/49/195, 21/51/96/155, 21/96, 21/96/195, 21/96/253, 44/46/47/51/114/178/253, 44/46/47/51/155/178/253, 44/46/47/96/155/195, 44/46/51/96/147/178/195/199, 44/46/51/96/155/195/199/253, 44/46/51/96/195, 44/46/51/147/155/178/195/253, 44/47/51/96/114, 44/47/51/96/177/178/199/253, 44/47/51/114/178/253, 44/47/96/114, 44/47/96/195/253, 44/47/147/155, 44/47/147/155/199, 44/96/155/178, 46/47/51/96/114/178, 46/47/51/114/147/195/199, 46/47/51/155/195/199, 46/47/96/114/195/199, 46/47/96/155/178/195/253, 46/47/155/195/199, 46/114/147/155/178/195/199, 46/114/195/199/253, 47/51/96, 47/51/96/114, 47/51/96/147/155/195/199, 47/51/96/147/195/199, 47/51/96/178/195/199/253, 47/51/96/195, 47/51/96/195/199/253, 47/51/114/253, 47/51/155/178/195, 47/51/155/195/253, 47/96/114, 47/96/114/253, 47/96/155/178/195, 47/96/155/195, 47/96/155/195/199, 47/96/178/195/253, 47/96/178/253, 47/96/195/199/253, 47/96/195/253, 47/114, 47/114/155/195/199, 47/114/178, 47/147/195, 47/155/253, 47/178/195, 47/178/195/199, 47/195/199, 49/51/96, 49/96, 49/96/253, 51/96, 51/96/114/155/195/199/253, 51/96/155/178, 51/96/155/178/195/253, 51/96/155/195, 51/96/155/195/253, 51/96/195/253, 51/96/199, 51/96/253, 51/114/155/195/199, 51/114/195/199, 51/147/253, 51/155/195/199, 51/195, 51/253, 96, 96/114/147/155/195/199, 96/114/155/178/195/199/253, 96/114/155/195/253, 96/114/199, 96/147, 96/147/155/178/195/253, 96/147/178/195/199, 96/147/195, 96/147/195/199, 96/147/253, 96/155/178/199, 96/155/195, 96/155/199, 96/155/253, 96/178/195, 96/178/195/199, 96/195, 96/195/199, 96/195/253, 96/199, 96/199/253, 96/253,114, 114/147/155/253, 114/178/195/199/253, 114/195, 114/195/199/253, 132, 147/155, 149, 154, 155/178, 155/178/195/199, 155/195, 155/195/199, 155/195/199/253, 155/195/253, 155/253, 157, 167, 170, 178, 178/195, 178/199, 195, 196, 198, 214, 218, 251, 252, 256, 257, 259, and 260.

In some embodiments, the polynucleotide capable of hybridizing under highly stringent conditions encodes an engineered glucose dehydrogenase polypeptide having imine reductase activity with improved properties comprising an amino acid sequence having at least 80%, 85%, 86%, 87%, 88%, 89%, 90%, 91%, 92%, 93%, 94%, 95%, 96%, 97%, 98%, 99% or more identity to SEQ ID NO:112, and one or more residue differences as compared to SEQ ID NO:112 at residue positions selected from: 21/42/96/178/195/253, 21/42/96/195, 21/96, 21/96/147/195, 21/96/149, 21/96/155/195/253, 21/96/167, 21/96/167/195, 21/96/179/195/251/253, 21/96/195, 21/147/149, 21/147/253, 21/149/178/195, 21/155/178/253/256, 21/178/195/256, 42/96/149/253/256, 94, 96, 96/114/155/198/218/253/256/ 257, 96/114/155/252/253/257, 96/114/155/253, 96/114/196/ 214/253/256, 96/114/214/253/256, 96/147, 96/147/149, 96/147/149/155, 96/147/167/195, 96/149/155/167/178/253, 96/149/155/195, 96/149/178/179/251/256, 96/149/178/253, 96/149/198/252/253/257, 96/155, 96/155/167, 96/155/167/ 178, 96/155/195, 96/155/196/218/253/256/257, 96/155/196/ 252/253, 96/155/198, 96/155/252/253, 96/167, 96/178, 96/178/179/195, 96/195, 96/196, 96/196/198, 96/196/201/ 256, 96/251/253/256, 96/253/257, 96/256/257, 98, 103, 114/ 253/256/257, 147, 147/149, 149/167, 149/195, 149/218, 149/253, 149/257, 155/167, 155/178/195, 155/178/195/251/ 253, 155/195/251/253/256, 155/195/253/256, 155/196/198/ 253, 167, 167/195, 167/195/251/253, 196, 196/253/256/257, 198/253/256, 198/256, 205, 214/253/256, 251, and 257.

In some embodiments, the polynucleotide capable of hybridizing under highly stringent conditions encodes an engineered glucose dehydrogenase polypeptide having imine reductase activity with improved properties comprising an amino acid sequence having at least 80%, 85%, 86%, 87%, 88%, 89%, 90%, 91%, 92%, 93%, 94%, 95%, 96%, 97%, 98%, 99% or more identity to SEQ ID NO:736, and one or more residue differences as compared to SEQ ID NO:736 at residue positions selected from: 21/47/96/114/ 155/251, 21/47/149/257, 21/47/155/178/257, 21/47/178, 21/47/178/251/256/257, 21/96/114/155/178, 21/114/155/ 251/257, 21/114/178/179, 21/155/178/209/256, 25/155, 25/178/256, 42/47/155/178, 47/114/149/178/251, 47/114/ 178/257, 47/149, 47/178, 47/178/179/251/257, 47/178/251/ 257, 96/114/155/198, 96/114/155/253/257, 96/253, 114/149/ 155/251/256, 114/149/178/256/257, 114/155/195/198/256, 114/209/256/257, 149, 149/256/257, 155, 155/178/179, 155/ 178/198/252/253, 155/195/198, 155/195/198/253/256/257, 155/256/257, 178/253, 178/256, 179/256/257, 251, and 253.

In some embodiments, the polynucleotide capable of hybridizing under highly stringent conditions encodes an engineered glucose dehydrogenase polypeptide having imine reductase activity with improved properties comprising an amino acid sequence having at least 80%, 85%, 86%, 87%, 88%, 89%, 90%, 91%, 92%, 93%, 94%, 95%, 96%, 97%, 98%, 99% or more identity to SEQ ID NO:908, and one or more residue differences as compared to SEQ ID NO:908 at residue positions selected from: 21/42/149, 21/42/149/214/253, 21/42/179/214/244/253, 21/42/253/ 260/261, 21/149, 21/149/179, 21/149/179/253, 21/149/179/ 253/260, 21/149/179/253/260/261, 21/149/179/261, 21/149/ 260/261, 21/149/261, 21/179/214/253, 21/179/253, 21/179/ 261, 21/214/253, 21/253, 40, 42/149/179/253/260, 42/149/ 179/260/261, 42/149/214/253, 42/179/253/261, 42/253,104, 111, 149, 149/179, 149/179/253, 149/179/253/260/261, 149/ 179/260, 149/179/260/261, 149/179/261, 149/253, 149/261, 160, 178, 179/214/253, 179/253, 179/253/260, 179/253/260/ 261, 179/253/261, 179/260/261, 179/261, 253, 253/260/261, 253/261, and 255.

In some embodiments, the polynucleotide capable of hybridizing under highly stringent conditions encodes an engineered glucose dehydrogenase polypeptide having imine reductase activity with improved properties comprising an amino acid sequence having at least 80%, 85%, 86%, 87%, 88%, 89%, 90%, 91%, 92%, 93%, 94%, 95%, 96%, 97%, 98%, 99% or more identity to SEQ ID NO:956, and one or more residue differences as compared to SEQ ID NO:956 at residue positions selected from: 3, 21/104/160/ 178/179, 21/104/160/255/258, 21/104/178/179/255, 21/104/ 178/255/258, 21/104/255, 21/104/255/258, 21/178/179/255/ 260, 21/255/260, 31, 32, 40, 40/104/178/179, 40/160/178, 46/82/259, 103, 104/149/255/258/260, 104/149/258, 104/ 160, 104/160/178, 104/160/178/179/255, 104/160/178/179/ 260, 104/160/178/255/260, 104/160/179, 104/178/179/255/ 258, 104/178/255/258/260, 104/178/255/260, 104/179, 104/ 255/260, 104/258/260, 111/149/255/258, 111/149/255/260, 111/160/178/179/255/258/260, 111/160/255/260, 154, 156, 160, 160/178/179, 174, 194, 197, 205, 205/229, 222, 253, 257, 258/260, and 260.

In some embodiments, the polynucleotide capable of hybridizing under highly stringent conditions encodes an engineered glucose dehydrogenase polypeptide having imine reductase activity with improved properties comprising an amino acid sequence having at least 80%, 85%, 86%, 87%, 88%, 89%, 90%, 91%, 92%, 93%, 94%, 95%, 96%, 97%, 98%, 99% or more identity to SEQ ID NO:1062, and one or more residue differences as compared to SEQ ID NO:1062 at residue positions selected from: 3/31/154/205/ 257, 3/31/205, 3/154/205, 31/55/154/205, 31/55/205, 31/154/205, 31/154/205/257, 31/205, 31/205/222, 40/55/ 205, 40/154/205, 40/154/205/257, 40/174/205/229, 40/205/ 229, 54/205/253, 63, 63/149/154/174/178/253, 63/149/154/ 174/205/253, 63/149/156/178/205/253, 63/149/205, 63/149/ 205/229/253, 63/149/205/253, 63/154, 63/154/178/205/253, 63/154/205, 63/154/205/229, 63/154/205/229/253, 63/154/ 205/253, 63/156, 63/156/205, 63/205, 63/205/253, 63/253, 67, 98, 149/154, 149/154/205, 149/156/253, 149/205, 149/ 205/253, 154, 154/160, 154/160/205, 154/160/205/222/257, 154/160/253, 154/174, 154/174/178/205, 154/174/205/229, 154/205, 154/205/222, 154/205/222/257, 154/205/229, 154/ 205/253, 154/205/257, 154/229, 154/253, 156/205, 156/205/ 253, 156/229/253, 160, 160/205, 160/205/229, 194, 205, 205/222, 205/229, 205/229/253, 205/253, 208, 226, and 253.

In some embodiments, the polynucleotide capable of hybridizing under highly stringent conditions encodes an engineered glucose dehydrogenase polypeptide having imine reductase activity with improved properties comprising an amino acid sequence having at least 80%, 85%, 86%, 87%, 88%, 89%, 90%, 91%, 92%, 93%, 94%, 95%, 96%, 97%, 98%, 99% or more identity to SEQ ID NO: 4, 14, 34, 112, 736, 908, 956, and/or 1062. In some embodiments, the polynucleotides encode the polypeptides described herein but have at least about 80%, 85%, 86%, 87%, 88%, 89%, 90%, 91%, 92%, 93%, 94%, 95%, 96%, 97%, 98%, or 99% or more sequence identity at the nucleotide level to a reference polynucleotide encoding the engineered glucose dehydrogenase. In some embodiments, the reference polynucleotide sequence is selected from SEQ ID NOs:5-1383.

In some embodiments, the polynucleotide capable of hybridizing under highly stringent conditions encodes an engineered glucose dehydrogenase polypeptide having imine reductase activity with improved properties comprising an amino acid sequence having at least 80%, 85%, 86%, 87%, 88%, 89%, 90%, 91%, 92%, 93%, 94%, 95%, 96%, 97%, 98%, 99% or more identity to SEQ ID NO:4. In some embodiments, the polynucleotides encode the polypeptides described herein but have at least about 80%, 85%, 86%, 87%, 88%, 89%, 90%, 91%, 92%, 93%, 94%, 95%, 96%, 97%, 98%, or 99% or more sequence identity at the nucleotide level to a reference polynucleotide encoding the engineered glucose dehydrogenase. In some embodiments, the reference polynucleotide sequence is selected from SEQ ID NOs:5-29.

In some embodiments, the polynucleotide capable of hybridizing under highly stringent conditions encodes an engineered glucose dehydrogenase polypeptide having imine reductase activity with improved properties comprising an amino acid sequence having at least 80%, 85%, 86%, 87%, 88%, 89%, 90%, 91%, 92%, 93%, 94%, 95%, 96%, 97%, 98%, 99% or more identity to SEQ ID NO:14. In some embodiments, the polynucleotides encode the polypeptides described herein but have at least about 80%, 85%, 86%, 87%, 88%, 89%, 90%, 91%, 92%, 93%, 94%, 95%, 96%, 97%, 98%, or 99% or more sequence identity at the nucleotide level to a reference polynucleotide encoding the engineered glucose dehydrogenase. In some embodiments, the reference polynucleotide sequence is selected from SEQ ID NOs:31-103.

In some embodiments, the polynucleotide capable of hybridizing under highly stringent conditions encodes an engineered glucose dehydrogenase polypeptide having imine reductase activity with improved properties comprising an amino acid sequence having at least 80%, 85%, 86%, 87%, 88%, 89%, 90%, 91%, 92%, 93%, 94%, 95%, 96%, 97%, 98%, 99% or more identity to SEQ ID NO: 34. In some embodiments, the polynucleotides encode the polypeptides described herein but have at least about 80%, 85%, 86%, 87%, 88%, 89%, 90%, 91%, 92%, 93%, 94%, 95%, 96%, 97%, 98%, or 99% or more sequence identity at the nucleotide level to a reference polynucleotide encoding the engineered glucose dehydrogenase. In some embodiments, the reference polynucleotide sequence is selected from SEQ ID NOs:105-701.

In some embodiments, the polynucleotide capable of hybridizing under highly stringent conditions encodes an engineered glucose dehydrogenase polypeptide having imine reductase activity with improved properties comprising an amino acid sequence having at least 80%, 85%, 86%, 87%, 88%, 89%, 90%, 91%, 92%, 93%, 94%, 95%, 96%, 97%, 98%, 99% or more identity to SEQ ID NO:112. In some embodiments, the polynucleotides encode the polypeptides described herein but have at least about 80%, 85%, 86%, 87%, 88%, 89%, 90%, 91%, 92%, 93%, 94%, 95%, 96%, 97%, 98%, or 99% or more sequence identity at the nucleotide level to a reference polynucleotide encoding the engineered glucose dehydrogenase. In some embodiments, the reference polynucleotide sequence is selected from SEQ ID NOs:703-875.

In some embodiments, the polynucleotide capable of hybridizing under highly stringent conditions encodes an engineered glucose dehydrogenase polypeptide having imine reductase activity with improved properties comprising an amino acid sequence having at least 80%, 85%, 86%, 87%, 88%, 89%, 90%, 91%, 92%, 93%, 94%, 95%, 96%, 97%, 98%, 99% or more identity to SEQ ID NO:736. In some embodiments, the polynucleotides encode the polypeptides described herein but have at least about 80%, 85%, 86%, 87%, 88%, 89%, 90%, 91%, 92%, 93%, 94%, 95%, 96%, 97%, 98%, or 99% or more sequence identity at the nucleotide level to a reference polynucleotide encoding the engineered glucose dehydrogenase. In some embodiments, the reference polynucleotide sequence is selected from SEQ ID NOs:877-953.

In some embodiments, the polynucleotide capable of hybridizing under highly stringent conditions encodes an engineered glucose dehydrogenase polypeptide having imine reductase activity with improved properties comprising an amino acid sequence having at least 80%, 85%, 86%, 87%, 88%, 89%, 90%, 91%, 92%, 93%, 94%, 95%, 96%, 97%, 98%, 99% or more identity to SEQ ID NO:908. In some embodiments, the polynucleotides encode the polypeptides described herein but have at least about 80%, 85%, 86%, 87%, 88%, 89%, 90%, 91%, 92%, 93%, 94%, 95%, 96%, 97%, 98%, or 99% or more sequence identity at the nucleotide level to a reference polynucleotide encoding the engineered glucose dehydrogenase. In some embodiments, the reference polynucleotide sequence is selected from SEQ ID NOs:955-1059.

In some embodiments, the polynucleotide capable of hybridizing under highly stringent conditions encodes an engineered glucose dehydrogenase polypeptide having imine reductase activity with improved properties comprising an amino acid sequence having at least 80%, 85%, 86%, 87%, 88%, 89%, 90%, 91%, 92%, 93%, 94%, 95%, 96%, 97%, 98%, 99% or more identity to SEQ ID NO:956. In some embodiments, the polynucleotides encode the polypeptides described herein but have at least about 80%, 85%, 86%, 87%, 88%, 89%, 90%, 91%, 92%, 93%, 94%, 95%, 96%, 97%, 98%, or 99% or more sequence identity at the nucleotide level to a reference polynucleotide encoding the engineered glucose dehydrogenase. In some embodiments, the reference polynucleotide sequence is selected from SEQ ID NOs:1061-1169.

In some embodiments, the polynucleotide capable of hybridizing under highly stringent conditions encodes an engineered glucose dehydrogenase polypeptide having imine reductase activity with improved properties comprising an amino acid sequence having at least 80%, 85%, 86%, 87%, 88%, 89%, 90%, 91%, 92%, 93%, 94%, 95%, 96%, 97%, 98%, 99% or more identity to SEQ ID NO:1062. In some embodiments, the polynucleotides encode the polypeptides described herein but have at least about 80%, 85%, 86%, 87%, 88%, 89%, 90%, 91%, 92%, 93%, 94%, 95%, 96%, 97%, 98%, or 99% or more sequence identity at the nucleotide level to a reference polynucleotide encoding the engineered glucose dehydrogenase. In some embodiments, the reference polynucleotide sequence is selected from SEQ ID NOs:1171-1383.

In some embodiments, an isolated polynucleotide encoding any of the engineered glucose dehydrogenase polypeptides provided herein is manipulated in a variety of ways to provide for expression of the polypeptide. In some embodiments, the polynucleotides encoding the polypeptides are provided as expression vectors where one or more control sequences is present to regulate the expression of the polynucleotides and/or polypeptides. Manipulation of the isolated polynucleotide prior to its insertion into a vector may be desirable or necessary depending on the expression vector. The techniques for modifying polynucleotides and nucleic acid sequences utilizing recombinant DNA methods are well known in the art.

In some embodiments, the control sequences include among other sequences, promoters, leader sequences, polyadenylation sequences, propeptide sequences, signal peptide sequences, and transcription terminators. As known in the art, suitable promoters can be selected based on the host cells used. For bacterial host cells, suitable promoters for directing transcription of the nucleic acid constructs of the present application, include, but are not limited to the promoters obtained from the *E. coli* lac operon, *Streptomyces coelicolor* agarase gene (dagA), *Bacillus subtilis* levansucrase gene (sacB), *Bacillus licheniformis* alpha-amylase gene (amyL), *Bacillus stearothermophilus* maltogenic amylase gene (amyM), *Bacillus amyloliquefaciens* alpha-amylase gene (amyQ), *Bacillus licheniformis* penicillinase gene (penP), *Bacillus subtilis* xylA and xylB genes, and prokaryotic beta-lactamase gene (See e.g., Villa-Kamaroff et al., Proc. Natl Acad. Sci. USA 75: 3727-3731 [1978]), as well as the tac promoter (See e.g., DeBoer et al., Proc. Natl Acad. Sci. USA 80: 21-25 [1983]). Exemplary promoters for filamentous fungal host cells, include promoters obtained from the genes for *Aspergillus oryzae* TAKA amylase,

*Rhizomucor miehei* aspartic proteinase, *Aspergillus niger* neutral alpha-amylase, *Aspergillus niger* acid stable alpha-amylase, *Aspergillus niger* or *Aspergillus awamori* glucoamylase (glaA), *Rhizomucor miehei* lipase, *Aspergillus oryzae* alkaline protease, *Aspergillus oryzae* triose phosphate isomerase, *Aspergillus nidulans* acetamidase, and *Fusarium oxysporum* trypsin-like protease (See e.g., WO 96/00787), as well as the NA2-tpi promoter (a hybrid of the promoters from the genes for *Aspergillus niger* neutral alpha-amylase and *Aspergillus oryzae* triose phosphate isomerase), and mutant, truncated, and hybrid promoters thereof. Exemplary yeast cell promoters can be from the genes can be from the genes for *Saccharomyces cerevisiae* enolase (ENO-1), *Saccharomyces cerevisiae* galactokinase (GAL1), *Saccharomyces cerevisiae* alcohol dehydrogenase/glyceraldehyde-3-phosphate dehydrogenase (ADH2/GAP), and *Saccharomyces cerevisiae* 3-phosphoglycerate kinase. Other useful promoters for yeast host cells are known in the art (See e.g., Romanos et al., Yeast 8:423-488 [1992]).

In some embodiments, the control sequence is a suitable transcription terminator sequence, a sequence recognized by a host cell to terminate transcription. The terminator sequence is operably linked to the 3' terminus of the nucleic acid sequence encoding the polypeptide. Any terminator which is functional in the host cell of choice finds use in the present invention. For example, exemplary transcription terminators for filamentous fungal host cells can be obtained from the genes for *Aspergillus oryzae* TAKA amylase, *Aspergillus niger* glucoamylase, *Aspergillus nidulans* anthranilate synthase, *Aspergillus niger* alpha-glucosidase, and *Fusarium oxysporum* trypsin-like protease. Exemplary terminators for yeast host cells can be obtained from the genes for *Saccharomyces cerevisiae* enolase, *Saccharomyces cerevisiae* cytochrome C (CYC1), and *Saccharomyces cerevisiae* glyceraldehyde-3-phosphate dehydrogenase. Other useful terminators for yeast host cells are known in the art (See e.g., Romanos et al., supra).

In some embodiments, the control sequence is a suitable leader sequence, a non-translated region of an mRNA that is important for translation by the host cell. The leader sequence is operably linked to the 5' terminus of the nucleic acid sequence encoding the polypeptide. Any leader sequence that is functional in the host cell of choice may be used. Exemplary leaders for filamentous fungal host cells are obtained from the genes for *Aspergillus oryzae* TAKA amylase and *Aspergillus nidulans* triose phosphate isomerase. Suitable leaders for yeast host cells include, but are not limited to those obtained from the genes for *Saccharomyces cerevisiae* enolase (ENO-1), *Saccharomyces cerevisiae* 3-phosphoglycerate kinase, *Saccharomyces cerevisiae* alpha-factor, and *Saccharomyces cerevisiae* alcohol dehydrogenase/glyceraldehyde-3-phosphate dehydrogenase (ADH2/GAP). The control sequence may also be a polyadenylation sequence, a sequence operably linked to the 3' terminus of the nucleic acid sequence and which, when transcribed, is recognized by the host cell as a signal to add polyadenosine residues to transcribed mRNA. Any polyadenylation sequence which is functional in the host cell of choice may be used in the present invention. Exemplary polyadenylation sequences for filamentous fungal host cells include, but are not limited to those from the genes for *Aspergillus oryzae* TAKA amylase, *Aspergillus niger* glucoamylase, *Aspergillus nidulans* anthranilate synthase, *Fusarium oxysporum* trypsin-like protease, and *Aspergillus niger* alpha-glucosidase. Useful polyadenylation sequences for yeast host cells are also known in the art (See e.g., Guo and Sherman, Mol. Cell. Bio., 15:5983-5990 [1995]).

In some embodiments, the control sequence is a signal peptide coding region that codes for an amino acid sequence linked to the amino terminus of a polypeptide and directs the encoded polypeptide into the cell's secretory pathway. The 5' end of the coding sequence of the nucleic acid sequence may inherently contain a signal peptide coding region naturally linked in translation reading frame with the segment of the coding region that encodes the secreted polypeptide. Alternatively, the 5' end of the coding sequence may contain a signal peptide coding region that is foreign to the coding sequence. Any signal peptide coding region that directs the expressed polypeptide into the secretory pathway of a host cell of choice finds use for expression of the engineered glucose dehydrogenase polypeptides provided herein.

Effective signal peptide coding regions for bacterial host cells include, but are not limited to the signal peptide coding regions obtained from the genes for *Bacillus* NC1B 11837 maltogenic amylase, *Bacillus stearothermophilus* alpha-amylase, *Bacillus licheniformis* subtilisin, *Bacillus licheniformis* beta-lactamase, *Bacillus stearothermophilus* neutral proteases (nprT, nprS, nprM), and *Bacillus subtilis* prsA.

Further signal peptides are known in the art (See e.g., Simonen and Palva, Microbiol. Rev., 57:109-137 [1993]). Effective signal peptide coding regions for filamentous fungal host cells include, but are not limited to the signal peptide coding regions obtained from the genes for *Aspergillus oryzae* TAKA amylase, *Aspergillus niger* neutral amylase, *Aspergillus niger* glucoamylase, *Rhizomucor miehei* aspartic proteinase, *Humicola insolens* cellulase, and *Humicola lanuginosa* lipase. Useful signal peptides for yeast host cells include, but are not limited to those from the genes for *Saccharomyces cerevisiae* alpha-factor and *Saccharomyces cerevisiae* invertase.

In some embodiments, the control sequence is a propeptide coding region that codes for an amino acid sequence positioned at the amino terminus of a polypeptide. The resultant polypeptide is referred to as a "proenzyme," "propolypeptide," or "zymogen," in some cases). A propolypeptide can be converted to a mature active polypeptide by catalytic or autocatalytic cleavage of the propeptide from the propolypeptide. The propeptide coding region includes, but is not limited to the genes for *Bacillus subtilis* alkaline protease (aprE), *Bacillus subtilis* neutral protease (nprT), *Saccharomyces cerevisiae* alpha-factor, *Rhizomucor miehei* aspartic proteinase, and *Myceliophthora thermophila* lactase (See e.g., WO 95/33836). Where both signal peptide and propeptide regions are present at the amino terminus of a polypeptide, the propeptide region is positioned next to the amino terminus of a polypeptide and the signal peptide region is positioned next to the amino terminus of the propeptide region.

In some embodiments, regulatory sequences are also utilized. These sequences facilitate the regulation of the expression of the polypeptide relative to the growth of the host cell. Examples of regulatory systems are those which cause the expression of the gene to be turned on or off in response to a chemical or physical stimulus, including the presence of a regulatory compound. In prokaryotic host cells, suitable regulatory sequences include, but are not limited to the lac, tac, and trp operator systems. In yeast host cells, suitable regulatory systems include, but are not limited to the ADH2 system or GAL1 system. In filamentous fungi, suitable regulatory sequences include, but are not limited to the TAKA alpha-amylase promoter, *Aspergillus niger* glucoamylase promoter, and *Aspergillus oryzae* glucoamylase promoter.

The present invention also provides recombinant expression vectors comprising a polynucleotide encoding an engineered glucose dehydrogenase polypeptide, and one or more expression regulating regions such as a promoter and a terminator, a replication origin, etc., depending on the type of hosts into which they are to be introduced. In some embodiments, the various nucleic acid and control sequences described above are combined together to produce a recombinant expression vector which includes one or more convenient restriction sites to allow for insertion or substitution of the nucleic acid sequence encoding the variant glucose dehydrogenase polypeptide at such sites. Alternatively, the polynucleotide sequence(s) of the present invention are expressed by inserting the polynucleotide sequence or a nucleic acid construct comprising the polynucleotide sequence into an appropriate vector for expression. In creating the expression vector, the coding sequence is located in the vector so that the coding sequence is operably linked with the appropriate control sequences for expression.

The recombinant expression vector may be any vector (e.g., a plasmid or virus), that can be conveniently subjected to recombinant DNA procedures and can result in the expression of the variant glucose dehydrogenase polynucleotide sequence. The choice of the vector will typically depend on the compatibility of the vector with the host cell into which the vector is to be introduced. The vectors may be linear or closed circular plasmids.

In some embodiments, the expression vector is an autonomously replicating vector (i.e., a vector that exists as an extra-chromosomal entity, the replication of which is independent of chromosomal replication, such as a plasmid, an extra-chromosomal element, a minichromosome, or an artificial chromosome). The vector may contain any means for assuring self-replication. In some alternative embodiments, the vector may be one which, when introduced into the host cell, is integrated into the genome and replicated together with the chromosome(s) into which it has been integrated. Furthermore, a single vector or plasmid or two or more vectors or plasmids which together contain the total DNA to be introduced into the genome of the host cell, or a transposon may be used.

In some embodiments, the expression vector preferably contains one or more selectable markers, which permit easy selection of transformed cells. A "selectable marker" is a gene the product of which provides for biocide or viral resistance, resistance to heavy metals, prototrophy to auxotrophy, and the like. Examples of bacterial selectable markers include, but are not limited to the dal genes from *Bacillus subtilis* or *Bacillus* lichenformis, or markers, which confer antibiotic resistance such as ampicillin, kanamycin, chloramphenicol or tetracycline resistance. Suitable markers for yeast host cells include, but are not limited to ADE2, HIS3, LEU2, LYS2, MET3, TRP1, and URA3. Selectable markers for use in a filamentous fungal host cell include, but are not limited to, amdS (acetamidase), argB (ornithine carbamoyltransferases), bar (phosphinothricin acetyltransferase), hph (hygromycin phosphotransferase), niaD (nitrate reductase), pyrG (orotidine-5'-phosphate decarboxylase), sC (sulfate adenyltransferase), and trpC (anthranilate synthase), as well as equivalents thereof. In another aspect, the present invention provides a host cell comprising a polynucleotide encoding at least one engineered glucose dehydrogenase polypeptide of the present invention, the polynucleotide being operatively linked to one or more control sequences for expression of the engineered glucose dehydrogenase enzyme(s) in the host cell. Host cells for use in expressing the polypeptides encoded by the expression vectors of the present invention are well known in the art and include but are not limited to, bacterial cells, such as *E. coli*, *Vibrio fluvialis*, *Streptomyces* and *Salmonella typhimurium* cells; fungal cells, such as yeast cells (e.g., *Saccharomyces cerevisiae* and *Pichia pastoris* [ATCC Accession No. 201178]); insect cells such as *Drosophila* S2 and *Spodoptera* Sf9 cells; animal cells such as CHO, COS, BHK, 293, and Bowes melanoma cells; and plant cells. Exemplary host cells are *Escherichia coli* strains (e.g., W3110 (ΔfhuA) and BL21).

Accordingly, in another aspect, the present invention provides methods for producing the engineered glucose dehydrogenase polypeptides, where the methods comprise culturing a host cell capable of expressing a polynucleotide encoding the engineered glucose dehydrogenase polypeptide under conditions suitable for expression of the polypeptide. In some embodiments, the methods further comprise the steps of isolating and/or purifying the glucose dehydrogenase polypeptides, as described herein.

Appropriate culture media and growth conditions for the above-described host cells are well known in the art. Polynucleotides for expression of the glucose dehydrogenase polypeptides may be introduced into cells by various methods known in the art. Techniques include, among others, electroporation, biolistic particle bombardment, liposome mediated transfection, calcium chloride transfection, and protoplast fusion.

The engineered glucose dehydrogenases with the properties disclosed herein can be obtained by subjecting the polynucleotide encoding the naturally occurring or engineered glucose dehydrogenase polypeptide to mutagenesis and/or directed evolution methods known in the art, and as described herein. An exemplary directed evolution technique is mutagenesis and/or DNA shuffling (See e.g., Stemmer, Proc. Natl. Acad. Sci. USA 91:10747-10751 [1994]; WO 95/22625; WO 97/0078; WO 97/35966; WO 98/27230; WO 00/42651; WO 01/75767 and U.S. Pat. No. 6,537,746). Other directed evolution procedures that can be used include, among others, staggered extension process (StEP), in vitro recombination (See e.g., Zhao et al., Nat. Biotechnol., 16:258-261 [1998]), mutagenic PCR (See e.g., Caldwell et al., PCR Methods Appl., 3:S136-S140 [1994]), and cassette mutagenesis (See e.g., Black et al., Proc. Natl. Acad. Sci. USA 93:3525-3529 [1996]).

For example, mutagenesis and directed evolution methods can be readily applied to polynucleotides to generate variant libraries that can be expressed, screened, and assayed. Mutagenesis and directed evolution methods are well known in the art (See e.g., U.S. Pat. Nos. 5,605,793, 5,811,238, 5,830,721, 5,834,252, 5,837,458, 5,928,905, 6,096,548, 6,117,679, 6,132,970, 6,165,793, 6,180,406, 6,251,674, 6,265,201, 6,277,638, 6,287,861, 6,287,862, 6,291,242, 6,297,053, 6,303,344, 6,309,883, 6,319,713, 6,319,714, 6,323,030, 6,326,204, 6,335,160, 6,335,198, 6,344,356, 6,352,859, 6,355,484, 6,358,740, 6,358,742, 6,365,377, 6,365,408, 6,368,861, 6,372,497, 6,337,186, 6,376,246, 6,379,964, 6,387,702, 6,391,552, 6,391,640, 6,395,547, 6,406,855, 6,406,910, 6,413,745, 6,413,774, 6,420,175, 6,423,542, 6,426,224, 6,436,675, 6,444,468, 6,455,253, 6,479,652, 6,482,647, 6,483,011, 6,484,105, 6,489,146, 6,500,617, 6,500,639, 6,506,602, 6,506,603, 6,518,065, 6,519,065, 6,521,453, 6,528,311, 6,537,746, 6,573,098, 6,576,467, 6,579,678, 6,586,182, 6,602,986, 6,605,430, 6,613,514, 6,653,072, 6,686,515, 6,703,240, 6,716,631, 6,825,001, 6,902,922, 6,917,882, 6,946,296, 6,961,664, 6,995,017, 7,024,312, 7,058,515, 7,105,297, 7,148,054, 7,220,566, 7,288,375, 7,384,387, 7,421,347, 7,430,477, 7,462,469, 7,534,564, 7,620,500, 7,620,502, 7,629,170, 7,702,464, 7,747,391, 7,747,393, 7,751,986, 7,776,598, 7,783,428, 7,795,030, 7,853,410, 7,868,138, 7,783,428, 7,873,477, 7,873,499, 7,904,249, 7,957,912, 7,981,614, 8,014,961, 8,029,988, 8,048,674, 8,058,001, 8,076,138, 8,108,150, 8,170,806, 8,224,580, 8,377,681, 8,383,346, 8,457,903, 8,504,498, 8,589,085, 8,762,066, 8,768,871, 9,593,326, and all related US, as well as PCT and non-US counterparts; Ling et al., Anal. Biochem., 254(2):157-78 [1997]; Dale et al., Meth. Mol. Biol., 57:369-74 [1996]; Smith, Ann. Rev. Genet., 19:423-462 [1985]; Botstein et al., Science, 229:1193-1201 [1985]; Carter, Biochem. J., 237: 1-7 [1986]; Kramer et al., Cell, 38:879-887 [1984]; Wells et al., Gene, 34:315-323 [1985]; Minshull et al., Curr. Op. Chem. Biol., 3:284-290 [1999]; Christians et al., Nat. Biotechnol., 17:259-264 [1999]; Crameri et al., Nature, 391: 288-291 [1998]; Crameri, et al., Nat. Biotechnol., 15:436-438 [1997]; Zhang et al., Proc. Nat. Acad. Sci. U.S.A., 94:4504-4509 [1997]; Crameri et al., Nat. Biotechnol., 14:315-319 [1996]; Stemmer, Nature, 370:389-391 [1994]; Stemmer, Proc. Nat. Acad. Sci. USA, 91:10747-10751 [1994]; WO 95/22625; WO 97/0078; WO 97/35966; WO 98/27230; WO 00/42651; WO 01/75767; and WO 2009/152336, all of which are incorporated herein by reference).

In some embodiments, the enzyme clones obtained following mutagenesis treatment are screened by subjecting the enzymes to a defined temperature (or other assay conditions, such as testing the enzyme's activity over a broad range of substrates) and measuring the amount of enzyme activity remaining after heat treatments or other assay conditions. Clones containing a polynucleotide encoding a glucose dehydrogenase polypeptide are then sequenced to identify the nucleotide sequence changes (if any), and used to express the enzyme in a host cell. Measuring enzyme activity from the expression libraries can be performed using any suitable method known in the art (e.g., standard biochemistry techniques, such as HPLC analysis).

In some embodiments, the clones obtained following mutagenesis treatment can be screened for engineered glucose dehydrogenases having one or more desired improved enzyme properties (e.g., improved regioselectivity). Measuring enzyme activity from the expression libraries can be performed using the standard biochemistry techniques, such as HPLC analysis and/or derivatization of products (pre or post separation), for example, using dansyl chloride or OPA (See e.g., Yaegaki et al., J Chromatogr. 356(1):163-70 [1986]).

When the sequence of the engineered polypeptide is known, the polynucleotides encoding the enzyme can be prepared by standard solid-phase methods, according to known synthetic methods. In some embodiments, fragments of up to about 100 bases can be individually synthesized, then joined (e.g., by enzymatic or chemical ligation methods, or polymerase mediated methods) to form any desired continuous sequence. For example, polynucleotides and oligonucleotides encoding portions of the glucose dehydrogenase can be prepared by chemical synthesis as known in the art (e.g., the classical phosphoramidite method of Beaucage et al., Tet. Lett. 22:1859-69 [1981], or the method described by Matthes et al., EMBO J. 3:801-05 [1984]) as typically practiced in automated synthetic methods. According to the phosphoramidite method, oligonucleotides are synthesized (e.g., in an automatic DNA synthesizer), purified, annealed, ligated and cloned in appropriate vectors. In addition, essentially any nucleic acid can be obtained from any of a variety of commercial sources. In some embodiments, additional variations can be created by synthesizing oligonucleotides containing deletions, insertions, and/or substitutions, and combining the oligonucleotides in various permutations to create engineered glucose dehydrogenases with improved properties.

Accordingly, in some embodiments, a method for preparing the engineered glucose dehydrogenase polypeptide comprises: (a) synthesizing a polynucleotide encoding a polypeptide comprising an amino acid sequence having at least about 80%, 85%, 86%, 87%, 88%, 89%, 90%, 91%, 92%, 93%, 94%, 95%, 96%, 97%, 98%, or 99% or more sequence identity to an amino acid sequence selected from the even-numbered sequences of SEQ ID NOs:6-1384, and having one or more residue differences as compared to SEQ ID NO:4, 14, 34,112, 736, 908, 956, and/or 1062; and (b) expressing the glucose dehydrogenase polypeptide encoded by the polynucleotide.

In some embodiments of the method, the polynucleotide encodes an engineered glucose dehydrogenase that has optionally one or several (e.g., up to 3, 4, 5, or up to 10) amino acid residue deletions, insertions and/or substitutions. In some embodiments, the amino acid sequence has optionally 1-2, 1-3, 1-4, 1-5, 1-6, 1-7, 1-8, 1-9, 1-10, 1-15, 1-20, 1-21, 1-22, 1-23, 1-24, 1-25, 1-30, 1-35, 1-40, 1-45, or 1-50 amino acid residue deletions, insertions and/or substitutions. In some embodiments, the amino acid sequence has optionally 1, 2, 3, 4, 5, 6, 7, 8, 9, 10, 11, 12, 13, 14, 15, 16, 17, 18, 19, 20, 21, 22, 23, 24, 25, 30, 30, 35, 40, 45, or 50 amino acid residue deletions, insertions and/or substitutions. In some embodiments, the amino acid sequence has optionally 1, 2, 3, 4, 5, 6, 7, 8, 9, 10, 11, 12, 13, 14, 15, 16, 18, 20, 21, 22, 23, 24, or 25 amino acid residue deletions, insertions and/or substitutions. In some embodiments, the substitutions can be conservative or non-conservative substitutions.

In some embodiments, any of the engineered glucose dehydrogenase enzymes expressed in a host cell can be recovered from the cells and/or the culture medium using any one or more of the well-known techniques for protein purification, including, among others, lysozyme treatment, sonication, filtration, salting-out, ultra-centrifugation, and chromatography. Suitable solutions for lysing and the high efficiency extraction of proteins from bacteria, such as E. coli, are commercially available (e.g., CelLytic B™ Sigma-Aldrich, St. Louis MO).

Chromatographic techniques for isolation of the glucose dehydrogenase polypeptide include, among others, reverse phase chromatography high performance liquid chromatography, ion exchange chromatography, gel electrophoresis, and affinity chromatography. Conditions for purifying a particular enzyme will depend, in part, on factors such as net charge, hydrophobicity, hydrophilicity, molecular weight, molecular shape, etc., and will be apparent to those having skill in the art.

In some embodiments, affinity techniques may be used to isolate the improved glucose dehydrogenase enzymes. For affinity chromatography purification, any antibody which specifically binds the glucose dehydrogenase polypeptide may be used. For the production of antibodies, various host animals, including but not limited to rabbits, mice, rats, etc., may be immunized by injection with a glucose dehydrogenase polypeptide, or a fragment thereof. The glucose dehydrogenase polypeptide or fragment may be attached to a suitable carrier, such as BSA, by means of a side chain functional group or linkers attached to a side chain functional group. In some embodiments, the affinity purification can use a specific ligand bound by the glucose dehydrogenase or dye affinity column (See e.g., EP0641862; Stellwagen, "Dye Affinity Chromatography," In *Current Protocols in Protein Science*, Unit 9.2-9.2.16 [2001]).

Methods of Using the Engineered Glucose Dehydrogenase Enzymes

In some embodiments, the glucose dehydrogenases described herein find use in processes for conversion of one or more suitable substrates to a product.

In another aspect, the engineered glucose dehydrogenase polypeptides disclosed herein can be used in a process for the conversion of the substrate Compound (2), or structural analogs thereof, and of the substrate Compound (3), or structural analogs thereof, to the product of Compound (1) or the corresponding structural analog. Generally the structural analogs of Compound (1) are encompassed within structural Formula (IV).

In some embodiments, the present disclosure provides a process for preparing a compound of structural Formula (IV):

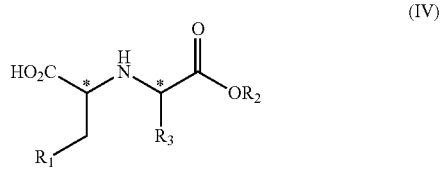

(IV)

wherein
R₁ is selected from a hydrogen atom, or optionally substituted alkyl, alkenyl, alkynyl, alkoxy, arylalkoxy, hydroxyalkyl, heteroalkyl, heteroalkenyl, heteroalkynyl, haloalkyl, alkylthioalkyl, cycloalkyl, aryl, arylalkyl, heterocycloalkyl, heteroaryl, and heteroarylalkyl; and R₂ is independently selected from alkyl, alkenyl, alkynyl, hydroxyalkyl, carboxy, aminocarbonyl, heteroalkyl, heteroalkenyl, heteroalkynyl, carboxyalkyl, alkylamino, haloalkyl, alkylthioalkyl, cycloalkyl, aryl, arylalkyl, heterocycloalkyl, heteroaryl, and heteroarylalkyl; and R₃ is independently selected from methyl, d3-methyl and ethyl;

the process comprising the step of contacting a ketone substrate of structural Formula (V) and an amine substrate of Formula (VI):

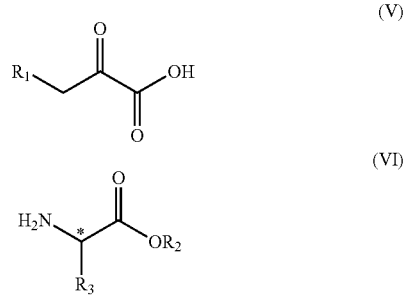

(V)

(VI)

with an engineered polypeptide as disclosed herein under suitable reaction conditions, such that a product of Formula (IV) is prepared.

In some embodiments, the present disclosure provides a process of preparing Compound (1);

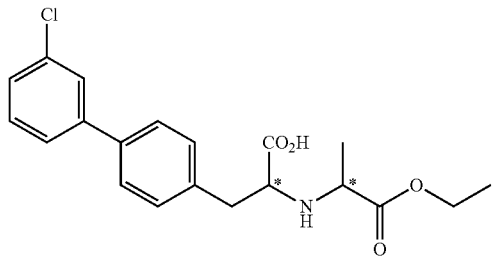

(1)

the process comprising a step of contacting a substrate of Compound (2)

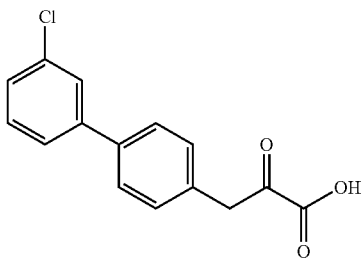

(2)

and a substrate of Compound (3)

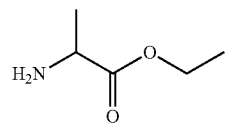

(3)

with an engineered polypeptide as disclosed herein under suitable reaction conditions, such that a product of Compound (1) is prepared.

In the embodiments provided herein and illustrated in the Examples, various ranges of suitable reaction conditions that can be used in the processes, include but are not limited to, substrate loading, co-substrate loading, pH, temperature, buffer, solvent system, polypeptide loading, and reaction time. Further suitable reaction conditions for carrying out the process for biocatalytic conversion of substrate compounds to product compounds using an engineered glucose dehydrogenases described herein can be readily optimized in view of the guidance provided herein by routine experimentation that includes, but is not limited to, contacting the engineered glucose dehydrogenase polypeptide and one or more substrate compounds under experimental reaction conditions of concentration, pH, temperature, and solvent conditions, and detecting the product compound.

The substrate compound(s) in the reaction mixtures can be varied, taking into consideration, for example, the desired amount of product compound, the effect of each substrate concentration on enzyme activity, stability of enzyme under reaction conditions, and the percent conversion of each substrate to product. In some embodiments, the suitable reaction conditions comprise a substrate compound loading for each of one or more substrates of at least about 0.5 to about 25 g/L, 1 to about 25 g/L, 5 to about 25 g/L, about 10 to about 25 g/L, or 20 to about 25 g/L. In some embodiments, the suitable reaction conditions comprise a substrate compound loading for each of one of more substrates of at least about 0.5 g/L, at least about 1 g/L, at least about 5 g/L, at least about 10 g/L, at least about 15 g/L, at least about 20 g/L, or at least about 30 g/L, or even greater.

In carrying out the glucose dehydrogenase mediated processes described herein, the engineered polypeptide may be added to the reaction mixture in the form of a purified enzyme, partially purified enzyme, whole cells transformed with gene(s) encoding the enzyme, as cell extracts and/or lysates of such cells, and/or as an enzyme immobilized on a solid support. Whole cells transformed with gene(s) encoding the engineered glucose dehydrogenase enzyme or cell extracts, lysates thereof, and isolated enzymes may be employed in a variety of different forms, including solid (e.g., lyophilized, spray-dried, and the like) or semisolid (e.g., a crude paste). The cell extracts or cell lysates may be partially purified by precipitation (ammonium sulfate, polyethyleneimine, heat treatment or the like, followed by a desalting procedure prior to lyophilization (e.g., ultrafiltration, dialysis, etc.). Any of the enzyme preparations (including whole cell preparations) may be stabilized by crosslinking using known crosslinking agents, such as, for example, glutaraldehyde or immobilization to a solid phase (e.g., Eupergit C, and the like).

The gene(s) encoding the engineered glucose dehydrogenase polypeptides can be transformed into host cell separately or together into the same host cell. For example, in some embodiments one set of host cells can be transformed with gene(s) encoding one engineered glucose dehydrogenase polypeptide and another set can be transformed with gene(s) encoding another engineered glucose dehydrogenase polypeptide. Both sets of transformed cells can be utilized together in the reaction mixture in the form of whole cells, or in the form of lysates or extracts derived therefrom. In other embodiments, a host cell can be transformed with gene(s) encoding multiple engineered glucose dehydrogenase polypeptides. In some embodiments the engineered polypeptides can be expressed in the form of secreted polypeptides and the culture medium containing the secreted polypeptides can be used for the glucose dehydrogenase reaction.

In some embodiments, the improved activity and/or regioselectivity and/or stereoselectivity of the engineered glucose dehydrogenase polypeptides disclosed herein provides for processes wherein higher percentage conversion can be achieved with lower concentrations of the engineered polypeptide. In some embodiments of the process, the suitable reaction conditions comprise an engineered polypeptide amount of about 1% (w/w), 2% (w/w), 5% (w/w), 10% (w/w), 20% (w/w), 30% (w/w), 40% (w/w), 50% (w/w), 75% (w/w), 100% (w/w) or more of substrate compound loading.

In some embodiments, the engineered polypeptide is present at about 0.01 g/L to about 50 g/L; about 0.05 g/L to about 50 g/L; about 0.1 g/L to about 40 g/L; about 1 g/L to about 40 g/L; about 2 g/L to about 40 g/L; about 5 g/L to about 40 g/L; about 5 g/L to about 30 g/L; about 0.1 g/L to about 10 g/L; about 0.5 g/L to about 10 g/L; about 1 g/L to about 10 g/L; about 0.1 g/L to about 5 g/L; about 0.5 g/L to about 5 g/L; or about 0.1 g/L to about 2 g/L. In some embodiments, the glucose dehydrogenase polypeptide is present at about 0.01 g/L, 0.05 g/L, 0.1 g/L, 0.2 g/L, 0.5 g/L, 1, 2 g/L, 5 g/L, 10 g/L, 15 g/L, 20 g/L, 25 g/L, 30 g/L, 35 g/L, 40 g/L, or 50 g/L.

During the course of the reaction, the pH of the reaction mixture may change. The pH of the reaction mixture may be maintained at a desired pH or within a desired pH range. This may be done by the addition of an acid or a base, before and/or during the course of the reaction. Alternatively, the pH may be controlled by using a buffer. Accordingly, in some embodiments, the reaction condition comprises a buffer. Suitable buffers to maintain desired pH ranges are known in the art and include, by way of example and not limitation, borate, phosphate, 2-(N-morpholino)ethanesulfonic acid (MES), 3-(N-morpholino)propanesulfonic acid (MOPS), acetate, triethanolamine, and 2-amino-2-hydroxymethyl-propane-1,3-diol (Tris), and the like. In some embodiments, the reaction conditions comprise water as a suitable solvent with no buffer present.

In the embodiments of the process, the reaction conditions comprise a suitable pH. The desired pH or desired pH range can be maintained by use of an acid or base, an appropriate buffer, or a combination of buffering and acid or base addition. The pH of the reaction mixture can be controlled before and/or during the course of the reaction. In some embodiments, the suitable reaction conditions comprise a solution pH from about 4 to about 10, pH from about 5 to about 10, pH from about 5 to about 9, pH from about 6 to about 9, pH from about 6 to about 8. In some embodiments, the reaction conditions comprise a solution pH of about 4, 4.5, 5, 5.5, 6, 6.5, 7, 7.5, 8, 8.5, 9, 9.5, or 10.

In the embodiments of the processes herein, a suitable temperature is used for the reaction conditions, for example, taking into consideration the increase in reaction rate at higher temperatures, and the activity of the enzyme during the reaction time period. Accordingly, in some embodiments, the suitable reaction conditions comprise a temperature of about 10° C. to about 60° C., about 10° C. to about 55° C., about 15° C. to about 60° C., about 20° C. to about 60° C., about 20° C. to about 55° C., about 25° C. to about 55° C., or about 30° C. to about 50° C. In some embodiments, the suitable reaction conditions comprise a temperature of about 10° C., 15° C., 20° C., 25° C., 30° C., 35° C., 40° C., 45° C., 50° C., 55° C., or 60° C. In some embodiments, the temperature during the enzymatic reaction can be maintained at a specific temperature throughout the course of the reaction. In some embodiments, the temperature during the enzymatic reaction can be adjusted over a temperature profile during the course of the reaction.

In some embodiments, the processes of the invention are carried out in a solvent. Suitable solvents include water, aqueous buffer solutions, organic solvents, polymeric solvents, and/or co-solvent systems, which generally comprise aqueous solvents, organic solvents and/or polymeric solvents. The aqueous solvent (water or aqueous co-solvent system) may be pH-buffered or unbuffered. In some embodiments, the processes using the engineered glucose dehydrogenase polypeptides can be carried out in an aqueous co-solvent system comprising an organic solvent (e.g., ethanol, isopropanol (IPA), dimethyl sulfoxide (DMSO), dimethylformamide (DMF) ethyl acetate, butyl acetate, 1-octanol, heptane, octane, methyl t butyl ether (MTBE), toluene, and the like), ionic or polar solvents (e.g., 1-ethyl 4 methylimidazolium tetrafluoroborate, 1-butyl-3-methylimidazolium tetrafluoroborate, 1-butyl 3 methylimidazolium hexafluorophosphate, glycerol, polyethylene glycol, and the like). In some embodiments, the co-solvent can be a polar solvent, such as a polyol, dimethylsulfoxide (DMSO), or lower alcohol. The non-aqueous co-solvent component of an aqueous co-solvent system may be miscible with the aqueous component, providing a single liquid phase, or may be partly miscible or immiscible with the aqueous component, providing two liquid phases. Exemplary aqueous co-solvent systems can comprise water and one or more co-solvents selected from an organic solvent, polar solvent, and polyol solvent. In general, the co-solvent component of an aqueous co-solvent system is chosen such that it does not adversely inactivate the glucose dehydrogenase enzyme under the reaction conditions. Appropriate co-solvent systems can be readily identified by measuring the enzymatic activity of the specified engineered glucose dehydrogenase enzyme with a defined substrate of interest in the candidate solvent system, utilizing an enzyme activity assay, such as those described herein.

In some embodiments of the process, the suitable reaction conditions comprise an aqueous co-solvent, where the co-solvent comprises DMSO at about 1% to about 50% (v/v), about 1 to about 40% (v/v), about 2% to about 40% (v/v), about 5% to about 30% (v/v), about 10% to about 30% (v/v), or about 10% to about 20% (v/v). In some embodiments of the process, the suitable reaction conditions can comprise an aqueous co-solvent comprising ethanol at about 1% (v/v), about 5% (v/v), about 10% (v/v), about 15% (v/v), about 20% (v/v), about 25% (v/v), about 30% (v/v), about 35% (v/v), about 40% (v/v), about 45% (v/v), or about 50% (v/v).

In some embodiments, the reaction conditions comprise a surfactant for stabilizing or enhancing the reaction. Surfactants can comprise non-ionic, cationic, anionic and/or amphiphilic surfactants. Exemplary surfactants, include by way of example and not limitation, nonyl phenoxypoly-ethoxylethanol (NP40), TRITON™ X-100 polyethylene glycol tert-octylphenyl ether, polyoxyethylene-stearylamine, cetyltrimethylammonium bromide, sodium oleylamido-sulfate, polyoxyethylene-sorbitanmonostearate, hexa-decyldimethylamine, etc. Any surfactant that may stabilize or enhance the reaction may be employed. The concentration of the surfactant to be employed in the reaction may be generally from 0.1 to 50 mg/ml, particularly from 1 to 20 mg/ml.

In some embodiments, the reaction conditions include an antifoam agent, which aids in reducing or preventing formation of foam in the reaction solution, such as when the reaction solutions are mixed or sparged. Anti-foam agents include non-polar oils (e.g., minerals, silicones, etc.), polar oils (e.g., fatty acids, alkyl amines, alkyl amides, alkyl sulfates, etc.), and hydrophobic (e.g., treated silica, polypropylene, etc.), some of which also function as surfactants. Exemplary anti-foam agents include, Y-30® (Dow Corning), poly-glycol copolymers, oxy/ethoxylated alcohols, and polydimethylsiloxanes. In some embodiments, the anti-foam can be present at about 0.001% (v/v) to about 5% (v/v), about 0.01% (v/v) to about 5% (v/v), about 0.1% (v/v) to about 5% (v/v), or about 0.1% (v/v) to about 2% (v/v). In some embodiments, the anti-foam agent can be present at about 0.001% (v/v), about 0.01% (v/v), about 0.1% (v/v), about 0.5% (v/v), about 1% (v/v), about 2% (v/v), about 3% (v/v), about 4% (v/v), or about 5% (v/v) or more as desirable to promote the reaction.

The quantities of reactants used in the glucose dehydrogenase reaction will generally vary depending on the quantities of product desired, and concomitantly the amount of glucose dehydrogenase substrate employed. Those having ordinary skill in the art will readily understand how to vary these quantities to tailor them to the desired level of productivity and scale of production.

In some embodiments, the order of addition of reactants is not critical. The reactants may be added together at the same time to a solvent (e.g., monophasic solvent, biphasic aqueous co-solvent system, and the like), or alternatively, some of the reactants may be added separately, and some together at different time points. For example, the cofactor, co-substrate and substrate may be added first to the solvent.

The solid reactants (e.g., enzyme, salts, etc.) may be provided to the reaction in a variety of different forms, including powder (e.g., lyophilized, spray dried, and the like), solution, emulsion, suspension, and the like. The reactants can be readily lyophilized or spray dried using methods and equipment that are known to those having ordinary skill in the art. For example, the protein solution can be frozen at −80° C. in small aliquots, then added to a pre-chilled lyophilization chamber, followed by the application of a vacuum.

For improved mixing efficiency when an aqueous co-solvent system is used, the glucose dehydrogenase, and co-substrate may be added and mixed into the aqueous phase first. The glucose dehydrogenase substrate may be added and mixed in, followed by the organic phase or the substrate may be dissolved in the organic phase and mixed in. Alternatively, the glucose dehydrogenase substrate may be premixed in the organic phase, prior to addition to the aqueous phase.

The processes of the present invention are generally allowed to proceed until further conversion of substrate to product does not change significantly with reaction time (e.g., less than 10% of substrate being converted, or less than 5% of substrate being converted). In some embodiments, the reaction is allowed to proceed until there is complete or near complete conversion of substrate to product. Transformation of substrate to product can be monitored using known methods by detecting substrate and/or product, with or without derivatization. Suitable analytical methods include gas chromatography, HPLC, MS, and the like.

In some embodiments of the process, the suitable reaction conditions comprise a substrate loading for each of one or more substrates of at least about 5 g/L, 10 g/L, 20 g/L, or more, and wherein the method results in at least about 50%, 60%, 70%, 80%, 90%, 95% or greater conversion of substrate compound to product compound in about in about 24 h or less, in about 12 h or less, in about 6 h or less, or in about 4 h or less.

The engineered glucose dehydrogenase polypeptides of the present invention when used in the process under suitable reaction conditions result in an excess of the desired product in at least 90%, 95%, 96%, 97%, 98%, 99%, or greater diastereomeric excess over undesired product(s).

In some further embodiments of the processes for converting one or more substrate compounds to product compound using the engineered glucose dehydrogenase polypeptides, the suitable reaction conditions can comprise an initial substrate loading for each of one or more substrates to the reaction solution which is then contacted by the polypeptide. This reaction solution is then further supplemented with additional substrate compound as a continuous or batchwise addition over time at a rate of at least about 1 g/L/h, at least about 2 g/L/h, at least about 4 g/L/h, at least about 6 g/L/h, or higher for each of one or more substrate compounds. Thus, according to these suitable reaction conditions, polypeptide is added to a solution having an initial substrate loading of at least about 1 g/L, 5 g/L, or 10 g/L for each of one or more substrate compounds. This addition of polypeptide is then followed by continuous addition of further substrate to the solution at a rate of about 2 g/L/h, 4 g/L/h, or 6 g/L/h for each of one or more substrate compounds until a much higher final substrate loading of at least about 30 g/L or more for each of one or more substrate compounds, is reached. Accordingly, in some embodiments of the process, the suitable reaction conditions comprise addition of the polypeptide to a solution having an initial substrate loading of at least about 1 g/L, 5 g/L, or 10 g/L followed by addition of further substrate to the solution at a rate of about 2 g/L/h, 4 g/L/h, or 6 g/L/h until a final substrate loading of at least about 30 g/L, or more, is reached for each of one or more substrate compounds. This substrate supplementation reaction condition allows for higher substrate loadings to be achieved while maintaining high rates of conversion of substrate to product of at least about 5%, 25%, 50%, 75%, 90% or greater conversion of substrate for either or both of one or more substrate compounds.

Any of the processes disclosed herein using the engineered polypeptides for the preparation of compounds of Formula (IV) or compound (1) can be carried out under a range of suitable reaction conditions, including but not limited to ranges of amine substrates, ranges of ketone substrates, temperature, pH, solvent system, substrate loading, polypeptide loading, cofactor loading, and reaction time. In one example, in some embodiments, the preparation of compounds of Formula (IV) or compound (1) can be carried out wherein the suitable reaction conditions comprise: (a) amine substrate loading of about 1 to 200 g/L of substrate compound; (b) ketone substrate loading of about 1 to 200 g/L of substrate compound; (c) of about 0.5 g/L to 25 g/L engineered polypeptide; (d) 0-20% DMSO; (e) 1 g/L of GDH cofactor recycling enzyme, 0.1 g/L of NAD+ cofactor, and up to 120 g/L glucose; (f) pH at 5.5-8; and (g) temperature of about 30° C. to 60° C. In some embodiments, the suitable reaction conditions comprise: (a) about 20 g/L of amine substrate compound); (b) about 20 g/L of ketone substrate compound); (c) about 5 g/L engineered polypeptide; (d) 10% DMSO; (e) 1 g/L of GDH cofactor recycling enzyme, 0.1 g/L NAD+ cofactor, and 20 g/L of glucose; (f) static pH at 6.5, and (g) about 30° C.

In some embodiments, additional reaction components or additional techniques carried out to supplement the reaction conditions. These can include taking measures to stabilize or prevent inactivation of the enzyme, reduce product inhibition, shift reaction equilibrium to formation of the desired product.

In further embodiments, any of the above described process for the conversion of one or more substrate compounds to product compound can further comprise one or more steps selected from: extraction; isolation; purification; and crystallization of product compound. Methods, techniques, and protocols for extracting, isolating, purifying, and/or crystallizing the product from biocatalytic reaction mixtures produced by the above disclosed processes are known to the ordinary artisan and/or accessed through routine experimentation. Additionally, illustrative methods are provided in the Examples below.

Various features and embodiments of the invention are illustrated in the following representative examples, which are intended to be illustrative, and not limiting.

EXPERIMENTAL

The following Examples, including experiments and results achieved, are provided for illustrative purposes only and are not to be construed as limiting the present invention.

In the Examples below, the following abbreviations apply: ppm (parts per million); M (molar); mM (millimolar), uM and µM (micromolar); nM (nanomolar); mol (moles); gm and g (gram); mg (milligrams); ug and µg (micrograms); L and l (liter); ml and mL (milliliter); cm (centimeters); mm (millimeters); um and gm (micrometers); sec. (seconds); min(s) (minute(s)); h(s) and hr(s) (hour(s)); U (units); MW (molecular weight); rpm (rotations per minute); psi and PSI (pounds per square inch); ° C. (degrees Centigrade); RT and rt (room temperature); CAM and cam (chloramphenicol); DMSO (dimethylsulfoxide); PMBS (polymyxin B sulfate); IPTG (isopropyl β-D-1-thiogalactopyranoside); LB (Luria-Bertani broth); TB (Terrific Broth; 12 g/L bacto-tryptone, 24 g/L yeast extract, 4 mL/L glycerol, 65 mM potassium phosphate, pH 7.0, 1 mM $MgSO_4$); HEPES (HEPES zwitterionic buffer; 4-(2-hydroxyethyl)-piperazineethanesulfonic acid); SFP (shake flask powder); CDS (coding sequence); DNA (deoxyribonucleic acid); RNA (ribonucleic acid); *E. coli* W3110 (commonly used laboratory *E. coli* strain, available from the *Coli* Genetic Stock Center [CGSC], New Haven, CT); HTP (high throughput); HPLC (high pressure liquid chromatography); FIOPC (fold improvements over positive control); Microfluidics (Microfluidics, Corp., Westwood, MA); Sigma-Aldrich (Sigma-Aldrich, St. Louis, MO; Difco (Difco Laboratories, BD Diagnostic Systems, Detroit, MI); Agilent (Agilent Technologies, Inc., Santa Clara, CA); Corning (Corning, Inc., Palo Alto, CA); Dow Corning (Dow Corning, Corp., Midland, MI); and Gene Oracle (Gene Oracle, Inc., Mountain View, CA).

Example 1

*E. coli* Expression Hosts Containing Recombinant GDH Genes

The initial GDH enzymes used to produce the variants of the present invention were obtained from U.S. Pat. Nos. 7,816,111 and 7,939,309. The GDH-encoding genes were cloned into the expression vector pCK110900 (See, FIG. 3 of US Pat. Appln. Publn. No. 2006/0195947) operatively linked to the lac promoter under control of the lacI repressor. The expression vector also contains the P15a origin of replication and the chloramphenicol resistance gene. The resulting plasmids were transformed into *E. coli* W3110, using standard methods known in the art. The transformants were isolated by subjecting the cells to chloramphenicol selection, as known in the art (See e.g., U.S. Pat. No. 8,383,346 and WO2010/144103).

Example 2

Preparation of HTP GDH-Containing Wet Cell Pellets

*E. coli* cells containing recombinant GDH-encoding genes from monoclonal colonies were inoculated into 180 µl LB containing 1% glucose and 30 µg/mL chloramphenicol in the wells of 96-well shallow well microtiter plates. The plates were sealed with $O_2$-permeable seals, and cultures were grown overnight at 30° C., 200 rpm and 85% humidity. Then, 10 µl of each of the cell cultures were transferred into the wells of 96-well deep well plates containing 390 mL TB and 30 µg/mL CAM. The deep-well plates were sealed with $O_2$-permeable seals and incubated at 30° C., 250 rpm and 85% humidity until $OD_{600}$ 0.6-0.8 was reached. The cell cultures were then induced by IPTG to a final concentration of 1 mM and incubated overnight under the same conditions as originally used. The cells were then pelleted using centrifugation at 4000 rpm for 10 min. In some cases, prior to centrifugation, the overnight cultures were combined from two plates, and double pellets were obtained. The supernatants were discarded and the pellets frozen at −80° C. prior to lysis.

Example 3

Preparation of HTP GDH-Containing Cell Lysates

First, 200 µl lysis buffer containing 200 mM Triethanolamine (TEoA) buffer, pH 8.5, 1 mg/mL lysozyme, and 0.5 mg/mL PMBS was added to the cell paste in each well, produced as described in Example 2. The cells were lysed at room temperature for 2 hours with shaking on a bench top shaker. The plate was then centrifuged for 15 min at 4000 rpm and 4° C. The clear supernatants were used in biocatalytic reactions to determine their activity levels.

Example 4

Preparation of Lyophilized Lysates from Shake Flask (SF) Cultures

Selected HTP cultures grown as described above were plated onto LB agar plates with 1% glucose and 30 µg/ml CAM and grown overnight at 37° C. A single colony from each culture was transferred to 6 ml of LB with 1% glucose and 30 µg/ml CAM. The cultures were grown for 18 h at 30° C., 250 rpm, and subcultured approximately 1:50 into 250 ml of TB containing 30 µg/ml CAM, to a final OD$_{600}$ of 0.05. The cultures were grown for approximately 195 minutes at 30° C., 250 rpm, to an OD$_{600}$ between 0.6-0.8 and induced with 1 mM IPTG. The cultures were then grown for 20 h at 30° C., 250 rpm. The cultures were centrifuged 4000 rpm for 20 min. The supernatant was discarded, and the pellets were resuspended in 30 ml of 200 mM TEoA buffer, pH 8.5. The cells were pelleted (4000 rpm for 20 min) and frozen at −80° C. for 120 minutes. Frozen pellets were resuspended in 30 ml of 200 mM TEoA buffer, pH 8.5, and lysed using a Microfluidizer system (Microfluidics) at 18,000 psi. The lysates were pelleted (10,000 rpm for 60 min), and the supernatants were frozen and lyophilized to generate shake flake (SF) enzymes.

Example 5

Improvements in Activity in GDH Relative to SEQ ID NO:4 in High Throughput Screening SEQ ID NO:4 was selected as the parent enzyme that was already evolved towards improved glucose activity and stability and disclosed in U.S. Pat. Nos. 7,816,111 and 7,939,309. SEQ ID NO:4 contains the following mutations compared to the wild-type enzyme of SEQ ID NO:2: E170K, Q252L, I165M, P194T. Libraries of engineered genes were produced using well established techniques (e.g., saturation mutagenesis, recombination of previously identified beneficial mutations). The polypeptides encoded by each gene were produced in HTP as described in Example 2, double pellets were obtained, and the soluble lysate was generated as described in Example 3.

To lyse the cells, 200 µl lysis buffer containing 200 mM TEoA buffer, pH 8.5, 1 mg/mL lysozyme, and 0.5 mg/mL PMBS was added to the cell paste. The cells were incubated at room temperature for 2 hours with shaking on a bench top shaker. The plate was then centrifuged for 15 minutes at 4000 rpm and 4° C., and the clear supernatants were used in subsequent biocatalytic reactions.

HTP reactions were carried out in 96-well deep well plates containing 200 µL of 0.2 M TEoA, pH 8.5, 1.25 g/L chloro-biphenylpyruvate, 3.6 g/L L-alanine-3,3,3-d3 ester (~5× molar equiv.), 5% DMSO, 25 µl above HTP supernatant, with either 0.5 g/L PDH 101, 25 mM phosphite, 1.5 g/L NAD+, or with only 20 g/L glucose and 6 g/L NAD+. The HTP plates were incubated in Thermotrons (3 mm throw, model #AJ185, Infors) at 30° C., 400 rpm, for 12 hours. The reactions were quenched by 0.1% formic acid in methanol at 1:10 ratio, the supernatant further diluted by water at 1:25 ratio, and then loaded into RapidFire for analysis.

Activity relative to SEQ ID NO:4 was calculated as fold improvement over positive control (FIOPC). It was determined by dividing the product mass spectra signal in each sample by the D3-chloro-biphenylpyruvate ester product mass spectra signal in the parent variant (positive control) present in the same plate under the specified reaction conditions and was shown in Table 5.1.

TABLE 5.1

Activity of Variant Relative to SEQ ID NO: 4

| SEQ ID NO: (nt/aa) | Amino Acid Differences (Relative to SEQ ID NO: 4) | FIOP ester (PDH) Relative to SEQ ID NO: 4 † | FIOP ester (NAD+) Relative to SEQ ID NO: 4 ‡ |
|---|---|---|---|
| 5/6 | H147A | ++ | |
| 7/8 | H147S | ++ | |
| 9/10 | F155N | ++ | ++ |
| 11/12 | F155A/Y253H | + | +++ |
| 13/14 | H147I | + | +++ |
| 15/16 | F256T | + | + |
| 17/18 | E96A | + | ++ |
| 19/20 | E96C/T118M | + | +++ |
| 21/22 | F256V | + | + |
| 23/24 | F256S | + | |
| 25/26 | F256A | + | + |
| 27/28 | F200W | + | + |
| 29/30 | I195G | | + |

† Levels of increased activity were determined relative to the reference polypeptide of SEQ ID NO: 4 and defined as follows: "+" 2.0 to 3.0, "++" >3.0
‡ Levels of increased activity were determined relative to the reference polypeptide of SEQ ID NO: 4 and defined as follows: "+" 2.0 to 3.0, "++" >3.0

Example 6

Improvements in Activity in GDH Relative to SEQ ID NO:14 in High Throughput Screening SEQ ID NO:14 was selected as the parent enzyme after screening variants described in Example 5. Libraries of engineered genes were produced using well established techniques (e.g., saturation mutagenesis, recombination of previously identified beneficial mutations). The polypeptides encoded by each gene were produced in HTP as described in Example 2, double pellets were obtained, and the soluble lysate was generated as described in Example 3.

To lyse the cells, 200 µl lysis buffer containing 200 mM TEoA buffer, pH 8.5, 1 mg/mL lysozyme, and 0.5 mg/mL PMBS was added to the cell paste. The cells were incubated at room temperature for 2 hours with shaking on a bench top shaker. The plate was then centrifuged for 15 minutes at 4000 rpm and 4° C., and the clear supernatants were used in subsequent biocatalytic reactions.

HTP reactions were carried out in 96-well deep well plates containing 200 µL of 0.2 M TEoA, pH 8.5, 1.25 g/L chloro-biphenylpyruvate, 3.5 g/L L-alanine ethyl ester (~5× molar equiv.), 5% DMSO, 25 µl above HTP supernatant, with 0.5 g/L PDH 101, 25 mM phosphite, 1.5 g/L NAD+. The HTP plates were incubated in Thermotrons (3 mm throw, model #AJ185, Infors) at 30° C., 400 rpm, for 12 hours. The reactions were quenched by 0.1% formic acid in methanol at 1:20 ratio, the supernatant further diluted by water at 1:20 ratio, and then loaded into RapidFire for analysis.

Activity relative to SEQ ID NO:14 was calculated as fold improvement over positive control (FIOPC). It was determined by dividing the product mass spectra signal in each sample by the chloro-biphenylpyruvate ester product mass spectra signal in the parent variant (positive control) present in the same plate under the specified reaction conditions.

TABLE 6.1

Activity of Variant Relative to SEQ ID NO: 14

| SEQ ID NO: (nt/aa) | Amino Acid Differences (Relative to SEQ ID NO: 14) | FIOP ester Relative to SEQ ID NO: 14 † |
|---|---|---|
| 31/32 | F155R | +++ |
| 33/34 | L95V/F155N/F200W | +++ |
| 35/36 | F155N/V156T/I195G/F200W/Y253H | +++ |
| 37/38 | L95V/F155N/V156A | +++ |
| 39/40 | F155N | +++ |
| 41/42 | L95V/E96C/A159T/I195G/Y253H | +++ |
| 43/44 | F155Q | +++ |
| 45/46 | E96C/F155N/A159T | ++ |
| 47/48 | F155N/V156A | ++ |
| 49/50 | L95V/F155N/A159C/F200W | ++ |
| 51/52 | L95V/E96A/I147Q/F200W/Y253H | ++ |
| 53/54 | I147Q/F155N/V156A/F200W | ++ |
| 55/56 | E96A/I147Q/I195G/F200W/Y253H | ++ |
| 57/58 | E96C/F155N/A159C/I195G | ++ |
| 59/60 | L95V/E96A/T118M/V156T/F200W/Y253H | ++ |
| 61/62 | E96S | ++ |
| 63/64 | L95V/E96C/I147Q | ++ |
| 65/66 | L95V/E96C/F155A/I195G/F200W | + |
| 67/68 | E96C/V156A/A159T/I195G/F200W | + |
| 69/70 | E96C/F155N/A159C | + |
| 71/72 | L95V/E96C | + |
| 73/74 | E96C/V156L/A159T/I195G | + |
| 75/76 | L95V/E96C/T118M | + |
| 77/78 | L95V/E96C/I147Q/F200W | + |
| 79/80 | I147T | + |
| 81/82 | L95V/E96C/F155N/V156Q | + |
| 83/84 | E96C/F155N/A159C/F200W | + |
| 85/86 | I147Q/I195G/F200W/Y253H | + |
| 87/88 | E96C/I195G | + |
| 89/90 | I147Q/F155N/A159C | + |
| 91/92 | I147Q/F155N/V156T | + |
| 93/94 | S17T | + |
| 95/96 | I147Q/F155N | + |
| 97/98 | E96C/F155A | + |
| 99/100 | Y253G | + |

TABLE 6.1-continued

Activity of Variant Relative to SEQ ID NO: 14

| SEQ ID NO: (nt/aa) | Amino Acid Differences (Relative to SEQ ID NO: 14) | FIOP ester Relative to SEQ ID NO: 14 † |
|---|---|---|
| 101/102 | Y253S | + |
| 103/104 | F155N/A159C/F200W | + |

† Levels of increased activity were determined relative to the reference polypeptide of SEQ ID NO: 14 and defined as follows: "+" 2.0 to 4.0, "++" >4.0, "+++" >10.0

Example 7

Improvements in Activity in GDH Relative to SEQ ID NO:34

SEQ ID NO:34 was selected as the parent enzyme after screening variants described in Example 6. Libraries of engineered genes were produced using well established techniques (e.g., saturation mutagenesis, recombination of previously identified beneficial mutations). The polypeptides encoded by each gene were produced in HTP as described in Example 2, double pellets being obtained, and the soluble lysate was generated as described in Example 3.

To lyse the cells, 200 µl lysis buffer containing 200 mM TEoA buffer, pH 8.5, 1 mg/mL lysozyme, and 0.5 mg/mL PMBS was added to the cell paste. The cells were incubated at room temperature for 2 hours with shaking on a bench top shaker. The plate was then centrifuged for 15 minutes at 4000 rpm and 4° C., and the clear supernatants were used in subsequent biocatalytic reactions.

HTP reactions were carried out in 96-well deep well plates containing 200 µL of 0.2 M TEoA, pH 8.5, 10 g/L chloro-biphenylpyruvate, 28 g/L L-alanine ethyl ester (~5× molar equiv.), 5% DMSO, 50 µl above HTP supernatant, with 1 g/L GDH 105, 10 g/L (~55 mM) glucose, 0.1 g/L NAD+. The HTP plates were incubated in Thermotrons (3 mm throw, model #AJ185, Infors) at 30° C., 400 rpm, for 12 hours. The reactions were quenched by 0.1% formic acid in methanol at 1:20 ratio, the supernatant further diluted by water at 1:400 ratio, and then loaded into RapidFire for analysis.

Activity relative to SEQ ID NO:34 was calculated as fold improvement over positive control (FIOPC). It was determined by dividing the product mass spectra signal in each sample by the chloro-biphenylpyruvate ester product mass spectra signal in the parent variant (positive control) present in the same plate under the specified reaction conditions.

TABLE 7.1

Activity of Variant Relative to SEQ ID NO: 34

| SEQ ID NO: (nt/aa) | Amino Acid Differences (Relative to SEQ ID NO: 34) | FIOP Relative to SEQ ID NO: 34 † |
|---|---|---|
| 105/106 | S17T/E47A/E96T/I147T/I195G/K199R/Y253G | +++ |
| 107/108 | S17T/D44N/E47L/E51A/E96A/G114A/I147T/I195G/K199R/Y253G | +++ |
| 109/110 | D44N/N46W/E51A/E96A/I147T/P178S/I195G/K199R | +++ |
| 111/112 | S17T/E47L/G114A/N155R/I195G/K199R/Y253S | +++ |
| 113/114 | E47A/E51A/E96C/P178S/I195G/K199R/Y253G | +++ |
| 115/116 | E47L/E51A/E96C/I195G/K199R/Y253G | +++ |
| 117/118 | S17T/N46W/E47L/E51A/E96C/I195G/Y253R | +++ |
| 119/120 | S17T/E47S/E96C/I195N/K199R | +++ |
| 121/122 | S17T/D44N/E47L/E51A/E96S/G114A/I147T/K199R | +++ |
| 123/124 | S17T/E96A/I195N/K199R | +++ |
| 125/126 | E96C/G114A/I147T/N155R/I195G/K199R | +++ |
| 127/128 | I195R | +++ |
| 129/130 | S17T/N46W/E47L/E51A/E96T/I147T | +++ |
| 131/132 | S17T/E96S/G114A/I147T/N155Q/P178S/I195G/K199R | +++ |

TABLE 7.1-continued

| SEQ ID NO: (nt/aa) | Amino Acid Differences (Relative to SEQ ID NO: 34) | FIOP Relative to SEQ ID NO: 34 † |
|---|---|---|
| Activity of Variant Relative to SEQ ID NO: 34 | | |
| 133/134 | E47A/E96S/I195N/Y253S | +++ |
| 135/136 | S17T/E96T/I195G/K199R | +++ |
| 137/138 | N46W/E47A/E51A/G114A/I147T/I195G/K199R | +++ |
| 139/140 | S17T/K21R/E96S/Y253L | +++ |
| 141/142 | S17T/E51A/E96S/N155Q/K199R | +++ |
| 143/144 | S17T/E47A/E51A/E96T/G114A/I147T/I195G | +++ |
| 145/146 | S17T/E96C/I195G/K199R | +++ |
| 147/148 | S17T/E47S/E96C/I147T/N155Q/I195G/K199R | +++ |
| 149/150 | E96N | +++ |
| 151/152 | E51A/E96T/I195G/Y253G | +++ |
| 153/154 | S17T/E47L/E96A/G114A/N155Q/Y253G | +++ |
| 155/156 | E96C/I147T/I195G/K199R | +++ |
| 157/158 | S17T/E51A/P178S/I195G/Y253G | +++ |
| 159/160 | S17T/D44N/E47L/E51A/E96T/G114A/I195G/K199R | +++ |
| 161/162 | S17T/E51A/I147T | +++ |
| 163/164 | E96T/K199R/Y253S | +++ |
| 165/166 | S17T/E51A/E96C/N155Q/I195G/K199R/Y253G | +++ |
| 167/168 | N46W/G114A/I147T/N155Q/P178S/I195G/K199R | +++ |
| 169/170 | N155R/I195G/K199R/Y253G | +++ |
| 171/172 | S17T/D44N/E51A/G114A/I195N/Y253G | +++ |
| 173/174 | E96S/Y253S | +++ |
| 175/176 | S17T/E47L/E51A/E96T/I195G/K199R | +++ |
| 177/178 | E47L/E96T/P178S/Y253G | +++ |
| 179/180 | S17T/D44N/E47S/E51A/P178S/I195N | +++ |
| 181/182 | S17T/K21R/I147T/N155R/Y253L | +++ |
| 183/184 | S17T/E96S/Y253L | +++ |
| 185/186 | E96S/Y253G | +++ |
| 187/188 | D44N/N46W/E51A/I147T/N155R/P178S/I195G/Y253G | +++ |
| 189/190 | E47L/E51A/E96S/I147T/N155Q/I195G/K199R | +++ |
| 191/192 | S17T/N155R/Y253G | +++ |
| 193/194 | N46W/E47L/E96C/N155R/P178S/I195G/Y253S | +++ |
| 195/196 | E47S/E96T/I195G/Y253S | +++ |
| 197/198 | S17T/E96T/I147T | +++ |
| 199/200 | S17T/K49A/E51L/E96S/I195N/Y253L | +++ |
| 201/202 | E47A/E96T/P178S/I195N/Y253R | +++ |
| 203/204 | S17T/P178S/I195N/Y253S | +++ |
| 205/206 | S17T/E96C/P178S/I195G | +++ |
| 207/208 | S17T/E96T/Y253R | +++ |
| 209/210 | E96C/P178S/I195G/K199R | +++ |
| 211/212 | E96T/I195G/Y253G | +++ |
| 213/214 | E96T/I195N/K199R | ++ |
| 215/216 | S17T/E51L/E96S/N155R/Y253L | ++ |
| 217/218 | E51A/E96S/K199R | ++ |
| 219/220 | E47L/E96A/I195G/K199R/Y253S | ++ |
| 221/222 | E51A/E96C/G114A/N155Q/I195G/K199R/Y253G | ++ |
| 223/224 | D44N/E47S/E96T/I195N/Y253G | ++ |
| 225/226 | D44N/N46W/E47A/E51A/N155R/P178S/Y253G | ++ |
| 227/228 | E96S/I147T | ++ |
| 229/230 | E96S/G114A/N155Q/I195N/Y253S | ++ |
| 231/232 | E96T/Y253G | ++ |
| 233/234 | N46W/E47L/E96T/G114A/I195N/K199R | ++ |
| 235/236 | E96C/Y253S | ++ |
| 237/238 | S17T/K21R/K49A/E51L/E96S | ++ |
| 239/240 | S17T/E96S/P178S | ++ |
| 241/242 | S17T/E51A/E96C/N155R/P178S | ++ |
| 243/244 | E96K | ++ |
| 245/246 | E51A/E96T/K199R | ++ |
| 247/248 | E96A/H47T/I195G | ++ |
| 249/250 | E47S/N155R/Y253G | ++ |
| 251/252 | S17T/I147T/P178S | ++ |
| 253/254 | S17T/N46W/E47A/E96C/I195G | ++ |
| 255/256 | S17T/K42T/E96S | ++ |
| 257/258 | S17T/K21R/E96S | ++ |
| 259/260 | E96T/I195G/Y253R | ++ |
| 261/262 | D44N/E47A/E51A/E96T/A177T/P178S/K199R/Y253S | ++ |
| 263/264 | E47A/H47T/I195G | ++ |
| 265/266 | S17T/K49A/E96S/N155R/Y253L | ++ |
| 267/268 | S17T/D44N/E47A/E51A/E96A | ++ |
| 269/270 | S17T/E51A/E96C/I195N | ++ |
| 271/272 | S17T/D44N/E47S/E51A/E96T/I147T/Y253G | ++ |
| 273/274 | S17T/K49A/E96S | ++ |
| 275/276 | E96T/K199R | ++ |
| 277/278 | E47A/E51A/N155R/I195G/Y253G | ++ |

TABLE 7.1-continued

Activity of Variant Relative to SEQ ID NO: 34

| SEQ ID NO: (nt/aa) | Amino Acid Differences (Relative to SEQ ID NO: 34) | FIOP Relative to SEQ ID NO: 34 † |
|---|---|---|
| 279/280 | E96A/H47T/Y253R | ++ |
| 281/282 | S17T/K21R/I195N | ++ |
| 283/284 | S17T/N46W/E96C/Y253G | ++ |
| 285/286 | S17T/K49A/E96S/I195N | ++ |
| 287/288 | S17T/E51A/E96S/G114A | ++ |
| 289/290 | S17T/E96C | ++ |
| 291/292 | S17T/N46W/E47A/P178S | ++ |
| 293/294 | S17T/N155Q/I195G/Y253S | ++ |
| 295/296 | E47L/E51A/E96C/H47T/I195G/K199R | ++ |
| 297/298 | E51A/E96T/Y253R | ++ |
| 299/300 | S17T/E96S/I195N | ++ |
| 301/302 | S17T/P178S | ++ |
| 303/304 | S17T/E96A/N155Q/I195G/K199R | ++ |
| 305/306 | E96A/I147T | ++ |
| 307/308 | S17T/K21R/E51L/E96S | ++ |
| 309/310 | E47L/E96T/G114A/Y253R | ++ |
| 311/312 | E96A/G114A/N155R/P178S/I195G/K199R/Y253G | ++ |
|

TABLE 7.1-continued

Activity of Variant Relative to SEQ ID NO: 34

| SEQ ID NO: (nt/aa) | Amino Acid Differences (Relative to SEQ ID NO: 34) | FIOP Relative to SEQ ID NO: 34 † |
|---|---|---|
| 425/426 | S17T/E47S | ++ |
| 427/428 | E47S/E51A/E96A | ++ |
| 429/430 | D44N/E47S/E51A/G114A/P178S/Y253S | ++ |
| 431/432 | L252T | ++ |
| 433/434 | D44N/E96C/N155R/P178S | ++ |
| 435/436 | E96T/P178S/I195G | ++ |
| 437/438 | S17T/K21R/E96S/N155R | ++ |
| 439/440 | S17T/K21R/K49A/E51L | ++ |
| 441/442 | E47S/E51A/E96C/G114A | + |
| 443/444 | S17T/E47A/E51A | + |
| 445/446 | S17T/K21R/E96S/I195N/R260G | + |
| 447/448 | S17T/K21R/K49A/E96S/N155R/R260G | + |
| 449/450 | S17T/E96S/N155R/I195N | + |
| 451/452 | E51A/E96C/N155R/P178S | + |
| 453/454 | S17T/I195N/K199R | + |
| 455/456 | S17T/I195G | + |
| 457/458 | E96S | + |
| 459/460 | E96T/N155Q/P178S/K199R | + |
| 461/462 | E96A/I195G | + |
| 463/464 | D44N/N46W/E47L/E96C/N155R/I195G | + |
| 465/466 | E96S/I195N | + |
| 467/468 | S17T/K42T/K49A/I195N/R260G | + |
| 469/470 | G114A/P178S/I195G/K199R/Y253S | + |
| 471/472 | S17T/K49A/E51L | + |
| 473/474 | S17T/D44N | + |
| 475/476 | N155Q/I195N | + |
| 477/478 | S17T/K21R/K49A | + |
| 479/480 | N46W/E47L/E51A/E96T/G114A/P178S | + |
| 481/482 | E47A/G114A | + |
| 483/484 | E96T/P178S/I195N | + |
| 485/486 | E47A/E51A/E96T/I195G | + |
| 487/488 | N155R/Y253S | + |
| 489/490 | E96C | + |
| 491/492 | S17T/N155R/P178S/I195G | + |
| 493/494 | E51A/E96C/N155Q/I195G/Y253G | + |
| 495/496 | S17T/K21R | + |
| 497/498 | E96A | + |
| 499/500 | D44N/N46W/E51A/E96T/N155R/I195G/K199R/Y253G | + |
| 501/502 | E51A/I147T/Y253S | + |
| 503/504 | S17T/K21R/K42T/N155R/R260G | + |
| 505/506 | D44N/N46W/E51A/E96T/I195G | + |
| 507/508 | S17T/E47A/E96A/N155Q | + |
| 509/510 | E96A/I147T/N155R/P178S/I195G/Y253G | + |
| 511/512 | D44N/E47S/E51A/E96S/G114A | + |
| 513/514 | S17T/I195N/Y253L | + |
| 515/516 | E51A/G114A/I195G/K199R | + |
| 517/518 | S17T/D44N/E47S/I195G/K199R | + |
| 519/520 | D44N/E47L/E96T/G114A | + |
| 521/522 | N155Q/P178S | + |
| 523/524 | D44N/E47S/I147T/N155Q | + |
| 525/526 | S17T/E51L/E96S/R260G | + |
| 527/528 | K21R/K49A/I195N | + |
| 529/530 | S17T/E51L | + |
| 531/532 | E96T | + |
| 533/534 | S17T/N155Q | + |
| 535/536 | G114A/I147T/N155Q/Y253S | + |
| 537/538 | S17T/K21R/K49A/R260G | + |
| 539/540 | S17T/K49A | + |
| 541/542 | S17T/N155R/Y253L | + |
| 543/544 | P178S | + |
| 545/546 | S17T/N155R/P178S | + |
| 547/548 | E47A/E96T/N155Q/I195N/K199R | + |
| 549/550 | F256I | + |
| 551/552 | S17T/E96A/I147T/N155R | + |
| 553/554 | S17T/K21R/K49A/E51L/R260G | + |
| 555/556 | P178A | + |
| 557/558 | E47S/E51A/G114A/Y253S | + |
| 559/560 | G259D | + |
| 561/562 | E96S/N155R/Y253L | + |
| 563/564 | S17T/I195G/K199R | + |
| 565/566 | E51A/G114A/N155Q/I195G/K199R | + |
| 567/568 | G114A/I195G | + |
| 569/570 | K170Q | + |

TABLE 7.1-continued

Activity of Variant Relative to SEQ ID NO: 34

| SEQ ID NO: (nt/aa) | Amino Acid Differences (Relative to SEQ ID NO: 34) | FIOP Relative to SEQ ID NO: 34 † |
|---|---|---|
| 571/572 | E96C/N155R/I195G | + |
| 573/574 | S17T/N46W/E47L/E51A/N155Q | + |
| 575/576 | E96T/I195G | + |
| 577/578 | E51A/N155Q/I195N/K199R | + |
| 579/580 | E47A/E96T/N155Q/P178S/I195G | + |
| 581/582 | E51A/Y253G | + |
| 583/584 | G259E | + |
| 585/586 | L154E | + |
| 587/588 | G114A | + |
| 589/590 | S17T/G114A/Y253R | + |
| 591/592 | E51A/I195N | + |
| 593/594 | N155Q/I195G/Y253G | + |
| 595/596 | N155Q/I195N/K199R | + |
| 597/598 | E51A/E96S/N155Q/I195G | + |
| 599/600 | E47S/E51A/N155R/P178S/I195N | + |
| 601/602 | S17T/K49A/R260G | + |
| 603/604 | S17T/N155Q/K199R | + |
| 605/606 | L167G | + |
| 607/608 | E51L/I195N | + |
| 609/610 | Q257E | + |
| 611/612 | P178G | + |
| 613/614 | S17T/K199R | + |
| 615/616 | E96T/I147T/P178S/I195N/K199R | + |
| 617/618 | D44N/E47S/I147T/N155Q/K199R | + |
| 619/620 | S17T/K21R/Y253L | + |
| 621/622 | S17T/I195G/K199R/Y253S | + |
| 623/624 | S17T/I147T/K199R | + |
| 625/626 | N46W/E47A/E51A/N155R/I195G/K199R | + |
| 627/628 | S17T | + |
| 629/630 | E47L/E51A/N155Q/I195G/Y253S | + |
| 631/632 | S17T/K49A/E51L/N155R/R260G | + |
| 633/634 | S17T/K49A/E51L/Y253L | + |
| 635/636 | T251A | + |
| 637/638 | N46W/E47L/N155R/I195N/K199R | + |
| 639/640 | T251L | + |
| 641/642 | S17T/R260G | + |
| 643/644 | V149D | + |
| 645/646 | E198H | + |
| 647/648 | N46W/G114A/I195G/K199R/Y253S | + |
| 649/650 | R260E | + |
| 651/652 | S17T/E51L/Y253L | + |
| 653/654 | E47L/G114A/N155R/I195G/K199R | + |
| 655/656 | S17T/Y253L | + |
| 657/658 | E51A/I195G | + |
| 659/660 | I195G | + |
| 661/662 | E47S/E96S/N155R/I195G | + |
| 663/664 | P214G | + |
| 665/666 | V132L | + |
| 667/668 | N196G | + |
| 669/670 | N155R/I195N/Y253L | + |
| 671/672 | Q257W | + |
| 673/674 | K21R/E51L/E96S/N155R | + |
| 675/676 | S17I/N155R/I195G | + |
| 677/678 | L252A | + |
| 679/680 | P178K | + |
| 681/682 | I218P | + |
| 683/684 | K21R/K49A/E51L | + |
| 685/686 | N196H | + |
| 687/688 | E47L/I195N/K199R | + |
| 689/690 | S17T/K49A/E51L/N155R/Y253L/R260G | + |
| 691/692 | I195N | + |
| 693/694 | P178S/K199R | + |
| 695/696 | S17T/E51A/N155R/I195G | + |
| 697/698 | I195S | + |
| 699/700 | S17T/N155R | + |
| 701/702 | E96T/N155Q/K199R | + |

† Levels of increased activity were determined relative to the reference polypeptide of SEQ ID NO: 34 and defined as follows: "+" 2.00 to 5.00, "++" >5.00, "+++" >15.00

Example 8

Improvements in Activity in GDH Relative to SEQ ID NO:112

SEQ ID NO:112 was selected as the parent enzyme after screening variants described in Example 7. Libraries of engineered genes were produced using well established techniques (e.g., saturation mutagenesis, recombination of previously identified beneficial mutations). The polypeptides encoded by each gene were produced in HTP as described in Example 2, single pellet being obtained, and the soluble lysate was generated as described in Example 3.

To lyse the cells, 200 µl lysis buffer containing 200 mM TEoA buffer, pH 8.5, 1 mg/mL lysozyme, and 0.5 mg/mL PMBS was added to the cell paste. The cells were incubated at room temperature for 2 hours with shaking on a bench top shaker. The plate was then centrifuged for 15 minutes at 4000 rpm and 4° C., and the clear supernatants were used in subsequent biocatalytic reactions.

HTP reactions were carried out in 96-well deep well plates containing 200 µL of 0.2 M TEoA, pH 9, 20 g/L chloro-biphenylpyruvate, 56 g/L L-alanine ethyl ester (~5× molar excess), 10% DMSO, 20 µl above HTP supernatant, with 1 g/L GDH 105, 20 g/L (~10 mM) glucose, 0.1 g/L NAD+. The HTP plates were incubated in Thermotrons (3 mm throw, model #AJ185, Infors) at 30° C., 400 rpm, for 12 hours. The reactions were quenched by 0.1% formic acid in methanol at 1:20 ratio, the supernatant further diluted by water at 1:400 ratio, and then loaded into RapidFire for analysis.

Activity relative to SEQ ID NO:112 was calculated as fold improvement over positive control (FIOPC). It was determined by dividing the product mass spectra signal in each sample by the chloro-biphenylpyruvate ester product mass spectra signal in the parent variant (positive control) present in the same plate under the specified reaction conditions.

TABLE 8.1

Activity of Variant Relative to SEQ ID NO: 112

| SEQ ID NO: (nt/aa) | Amino Acid Differences (Relative to SEQ ID NO: 112) | FIOP Relative to SEQ ID NO: 112 † |
|---|---|---|
| 703/704 | V149D/Q257E | +++ |
| 705/706 | E96C/R155N/N196G/L252T/S253G | +++ |
| 707/708 | K42T/E96C/V149E/S253G/F256I | +++ |
| 709/710 | E96S/F256I/Q257E | +++ |
| 711/712 | E96C/V149E/R155N/G195R | +++ |
| 713/714 | L167Q | +++ |
| 715/716 | R155N/L167Q | +++ |
| 717/718 | L167Q/G195N | +++ |
| 719/720 | P214G/S253G/F256I | +++ |
| 721/722 | E96S/A114G/P214G/S253G/F256I | +++ |
| 723/724 | E96A/R155N/L167Q | +++ |
| 725/726 | E96S/T251A/S253G/F256I | +++ |
| 727/728 | V149E/L167Q | +++ |
| 729/730 | Q257E | +++ |
| 731/732 | E198H/S253G/F256I | ++ |
| 733/734 | E96G/R155N/L167Q | ++ |
| 735/736 | I147R | ++ |
| 737/738 | L167Q/G195N/T251A/S253G | ++ |
| 739/740 | E96C/R155N/N196G/I218P/S253G/F256I/Q257E | ++ |
| 741/742 | R155N/N196G/E198H/S253G | ++ |
| 743/744 | V149E/I218P | ++ |
| 745/746 | E96K/R155N | ++ |
| 747/748 | T251L | ++ |
| 749/750 | E96S | ++ |
| 751/752 | E96C/N196G/A201P/F256I | ++ |
| 753/754 | E96C/A114G/R155N/L252A/S253G/Q257W | ++ |
| 755/756 | V149E/G195N | ++ |
| 757/758 | K21R/H47T/V149E | ++ |
| 759/760 | E96A/V149E/R155N/L167Q/P178S/S253G | ++ |
| 761/762 | E96S/S253G/Q257E | ++ |
| 763/764 | E96S/R155N | ++ |
| 765/766 | E96C/G195N | ++ |
| 767/768 | K21R/E96C/G195R | ++ |
| 769/770 | E96C/A114G/R155N/S253R | ++ |
| 771/772 | E96S/N196G | ++ |
| 773/774 | E96C | ++ |
| 775/776 | K21R/E96S/K179N/G195N/T251A/S253G | ++ |
| 777/778 | E96C/I147T | ++ |
| 779/780 | E96G/R155N/G195R | ++ |
| 781/782 | K21R/K42T/E96C/P178S/G195N/S253G | ++ |
| 783/784 | R155N/P178S/G195R | ++ |
| 785/786 | E96S/A114G/R155N/E198H/I218P/S253R/F256I/Q257E | + |
| 787/788 | E96C/A114G/N196G/P214G/S253G/F256I | + |
| 789/790 | K21R/E96K/L167Q | + |
| 791/792 | E96C/R155N/E198H | + |
| 793/794 | R155N/G195N/T251A/S253G/F256I | + |
| 795/796 | K21R/E96C/P178S | + |
| 797/798 | K21R/K42T/E96G/G195R | + |
| 799/800 | K21R/P178S/G195R/F256I | + |
| 801/802 | E96S/R155N/L167Q/P178S | + |
| 803/804 | P98A | + |
| 805/806 | R155N/P178S/G195R/T251A/S253G | + |
| 807/808 | K21R/E96C/I147T/G195R | + |
| 809/810 | E96S/P178S | + |
| 811/812 | E96S/V149E/P178S/K179N/T251A/F256I | + |
| 813/814 | A114G/S253G/F256I/Q257E | + |
| 815/816 | V149E/S253G | + |
| 817/818 | E96K/P178S | + |
| 819/820 | E96S/P178S/K179N/G195N | + |
| 821/822 | E96C/I147T/V149E/R155C | + |
| 823/824 | K21R/E96G/L167Q/G195N | + |
| 825/826 | K21R/I147T/S253G | + |
| 827/828 | I147T | + |
| 829/830 | E96S/G195N | + |
| 831/832 | N196G/S253G/F256I/Q257W | + |
| 833/834 | K21R/E96S/P178S | + |
| 835/836 | E96C/I147T/L167Q/G195N | + |
| 837/838 | K21R/E96C/V149E | + |
| 839/840 | E96S/L167Q | + |
| 841/842 | K21R/V149E/P178S/G195N | + |
| 843/844 | E96S/I147T/V149E | + |
| 845/846 | K21R/E96S | + |
| 847/848 | E96G/V149E/P178S/S253G | + |
| 849/850 | I147T/V149E | + |
| 851/852 | K21R/R155N/P178S/S253G/F256I | + |
| 853/854 | R155N/G195N/S253G/F256I | + |
| 855/856 | E96S/N196G/E198H | + |
| 857/858 | K21R/E96G/R155N/G195R/S253G | + |
| 859/860 | E96C/V149D/E198H/L252A/S253R/Q257E | + |
| 861/862 | E96C/R155N/L252T/S253R | + |
| 863/864 | E96C/V149E/R155N/G195N | + |
| 865/866 | E103L | + |
| 867/868 | G94A | + |
| 869/870 | I147A | + |
| 871/872 | Q205E | + |
| 873/874 | E198H/F256I | + |
| 875/876 | N196A | + |

† Levels of increased activity were determined relative to the reference polypeptide of SEQ ID NO: 112 and defined as follows: "+" 2.0 to 3.0, "++" >3.0, "+++" >5.0

Example 9

Improvements in Activity in GDH Relative to SEQ ID NO:736

SEQ ID NO:736 was selected as the parent enzyme after screening variants described in Example 8. Libraries of engineered genes were produced using well established techniques (e.g., saturation mutagenesis, recombination of previously identified beneficial mutations). The polypeptides encoded by each gene were produced in HTP as described in Example 2, single pellet being obtained, and the soluble lysate was generated as described in Example 3.

To lyse the cells, 200 μl lysis buffer containing 200 mM TEoA buffer, pH 8.5, 1 mg/mL lysozyme, and 0.5 mg/mL PMBS was added to the cell paste. The cells were incubated at room temperature for 2 hours with shaking on a bench top shaker. The plate was then centrifuged for 15 minutes at 4000 rpm and 4° C., and the clear supernatants were used in subsequent biocatalytic reactions.

HTP reactions were carried out in 96-well deep well plates containing 200 μL of 0.2 M TEOA, pH 9, 20 g/L chloro-biphenylpyruvate, 56 g/L L-alanine ethyl ester (~5× molar excess), 10% DMSO, 4 μl above HTP supernatant, with 1 g/L GDH 105, 20 g/L (~110 mM) glucose, 0.1 g/L NAD+. The HTP plates were incubated in Thermotrons (3 mm throw, model #AJ185, Infors) at 30° C., 400 rpm, for 12 hours. The reactions were quenched by acetonitrile at 1:1.5 ratio, then by 0.1% formic acid in methanol at 1:20 ratio, the supernatant further diluted by water at 1:400 ratio, and then loaded into RapidFire for analysis.

Activity relative to SEQ ID NO:736 was calculated as fold improvement over positive control (FIOPC). It was determined by dividing the product mass spectra signal in each sample by the chloro-biphenylpyruvate ester product mass spectra signal in the parent variant (positive control) present in the same plate under the specified reaction conditions.

TABLE 9.1

Activity of Variant Relative to SEQ ID NO: 736

| SEQ ID NO: (nt/aa) | Amino Acid Differences (Relative to SEQ ID NO: 736) | FIOP Relative to SEQ ID NO: 736 † |
|---|---|---|
| 877/878 | T251I | +++ |
| 879/880 | T251L | +++ |
| 881/882 | V149E | +++ |
| 883/884 | K21R/L47A/P178S/T251A/F256I/Q257W | +++ |
| 885/886 | A114G/V149E/P178S/F256I/Q257E | +++ |
| 887/888 | L47A/A114G/V149E/P178S/T251A | ++ |
| 889/890 | K179N/F256I/Q257E | ++ |
| 891/892 | R155N/F256I/Q257E | ++ |
| 893/894 | K21R/L47A/V149E/Q257E | ++ |
| 895/896 | L47A/P178S/T251A/Q257E | ++ |
| 897/898 | R155N | ++ |
| 899/900 | K21R/E96A/A114G/R155N/P178S | ++ |
| 901/902 | L47A/P178S/K179N/T251A/Q257E | ++ |
| 903/904 | K21R/L47A/P178S | ++ |
| 905/906 | V149E/F256I/Q257E | ++ |
| 907/908 | K21R/L47A/R155N/P178S/Q257E | ++ |
| 909/910 | K21R/A114G/R155N/T251A/Q257E | + |
| 911/912 | K21R/L47A/E96A/A114G/R155N/T251A | + |
| 913/914 | P178S/F256I | + |
| 915/916 | L47A/A114G/P178S/Q257E | + |
| 917/918 | L47A/P178S | + |
| 919/920 | R155N/P178S/K179N | + |
| 921/922 | L47A/V149E | + |
| 923/924 | K42T/L47A/R155N/P178S | + |
| 925/926 | A114G/V209L/F256I/Q257E | + |
| 927/928 | A114G/V149E/R155N/T251A/F256I | + |
| 929/930 | K21R/R155N/P178S/V209L/F256I | + |
| 931/932 | K21R/A114G/P178S/K179N | + |
| 933/934 | E96T/A114G/R155N/S253G/Q257W | + |
| 935/936 | P178S/S253G | + |
| 937/938 | I25L/R155N | + |
| 939/940 | I25L/P178S/F256I | + |
| 941/942 | A114G/R155N/G195N/E198L/F256I | + |
| 943/944 | E96T/A114G/R155N/E198L | + |
| 945/946 | R155N/P178S/E198H/L252T/S253G | + |
| 947/948 | E96T/S253G | + |
| 949/950 | R155N/G195N/E198L | + |
| 951/952 | S253G | + |
| 953/954 | R155N/G195N/E198H/S253G/F256I/Q257W | + |

† Levels of increased activity were determined relative to the reference polypeptide of SEQ ID NO: 736 and defined as follows: "+" 2.0 to 3.0, "++" >3.0, "+++" >5.0

Example 10

Improvements in Activity in GDH Relative to SEQ ID NO:908

SEQ ID NO:908 was selected as the parent enzyme after screening variants described in Example 9. Libraries of engineered genes were produced using well established techniques (e.g., saturation mutagenesis, recombination of previously identified beneficial mutations). The polypeptides encoded by each gene were produced in HTP as described in Example 2, single pellet being obtained, and the soluble lysate was generated as described in Example 3.

To lyse the cells, 200 μl lysis buffer containing 200 mM TEoA buffer, pH 8.5, 1 mg/mL lysozyme, and 0.5 mg/mL PMBS was added to the cell paste. The cells were incubated at room temperature for 2 hours with shaking on a bench top shaker. The plate was then centrifuged for 15 minutes at 4000 rpm and 4° C., and the clear supernatants were used in subsequent biocatalytic reactions.

HTP reactions were carried out in 96-well deep well plates containing 200 μL of 0.2 M TEoA, pH 9, 20 g/L chloro-biphenylpyruvate, 22 g/L L-alanine ethyl ester (~2× molar excess), 10% DMSO, 2 μl above HTP supernatant, with 1 g/L GDH 105, 20 g/L (~110 mM) glucose, 0.1 g/L NAD+. The HTP plates were incubated in Thermotrons (3 mm throw, model #AJ185, Infors) at 30C, 400 rpm, for 12 hours. The reactions were quenched by acetonitrile at 1:2 ratio, then by 0.1% formic acid in methanol at 1:20 ratio, the supernatant further diluted by water at 1:100 ratio, and then loaded into RapidFire for analysis.

Activity relative to SEQ ID NO:908 was calculated as fold improvement over positive control (FIOPC). It was determined by dividing the product mass spectra signal in each sample by the chloro-biphenylpyruvate ester product mass spectra signal in the parent variant (positive control) present in the same plate under the specified reaction conditions.

TABLE 10.1

Activity of Variant Relative to SEQ ID NO: 908

| SEQ ID NO: (nt/aa) | Amino Acid Differences (Relative to SEQ ID NO: 908) | FIOP Relative to SEQ ID NO: 908 † |
|---|---|---|
| 955/956 | K42T/K179N/S253G/G261E | +++ |
| 957/958 | K42T/V149E/K179R/S253G/R260Q | +++ |
| 959/960 | S253G/R260Q/G261E | +++ |
| 961/962 | R21K/K42T/S253G/R260Q/G261E | +++ |
| 963/964 | K179R/S253G/R260Q/G261E | +++ |
| 965/966 | V149E/K179N/S253G | +++ |
| 967/968 | K179N/S253G/R260Q | +++ |
| 969/970 | R21K/V149E/K179N/S253G | +++ |
| 971/972 | V149E/K179R/S253G | +++ |
| 973/974 | V149E/K179N/S253G/R260Q/G261E | +++ |
| 975/976 | K179R/S253G/G261E | +++ |
| 977/978 | R21K/V149E/K179R/S253G/R260Q/G261E | ++ |
| 979/980 | K179R/P214A/S253G | ++ |
| 981/982 | R21K/K179R/P214A/S253G | ++ |
| 983/984 | V149E/S253G | ++ |
| 985/986 | V149E/K179R/R260Q/G261E | ++ |
| 987/988 | S253G/G261E | ++ |
| 989/990 | K179R/S253G/R260Q | ++ |
| 991/992 | K42T/V149E/K179N/R260Q/G261E | ++ |
| 993/994 | K179N/S253G | ++ |
| 995/996 | R21K/K179R/S253G | ++ |
| 997/998 | M104L | ++ |
| 999/1000 | R21K/K179N/S253G | ++ |
| 1001/1002 | R21K/P214A/S253G | ++ |
| 1003/1004 | R21K/V149E/K179N | ++ |
| 1005/1006 | V149E/K179R/R260Q | ++ |
| 1007/1008 | R21K/K42T/V149E/P214A/S253G | ++ |
| 1009/1010 | V149E/K179R/G261E | + |
| 1011/1012 | V149E/K179R | + |
| 1013/1014 | R21K/V149E/R260Q/G261E | + |
| 1015/1016 | K42T/S253G | + |
| 1017/1018 | S255P | + |
| 1019/1020 | R21K/V149E/K179R | + |
| 1021/1022 | K179R/S253G | + |
| 1023/1024 | S253G | + |
| 1025/1026 | K42T/V149E/P214A/S253G | + |
| 1027/1028 | K111L | + |
| 1029/1030 | R21K/V149E/K179N/G261E | + |
| 1031/1032 | R21K/S253G | + |
| 1033/1034 | V149E/G261E | + |
| 1035/1036 | R21K/K42T/V149E | + |
| 1037/1038 | R21K/V149E/K179R/S253R/R260Q | + |
| 1039/1040 | R21K/V149E/G261E | + |
| 1041/1042 | S40T | + |
| 1043/1044 | R21K/K42T/K179R/P214A/L244F/S253G | + |
| 1045/1046 | V149E | + |
| 1047/1048 | A160S | + |
| 1049/1050 | V149E/S253R | + |
| 1051/1052 | R21K/K179R/G261E | + |
| 1053/1054 | S178L | + |
| 1055/1056 | K179R/G261E | + |
| 1057/1058 | R21K/V149E | + |
| 1059/1060 | K179R/R260Q/G261E | + |

† Levels of increased activity were determined relative to the reference polypeptide of SEQ ID NO: 908 and defined as follows: "+" 1.5 to 2.0, "++" >2.0, "+++" >2.5

Example 11

Improvements in Activity in GDH Relative to SEQ ID NO:956

SEQ ID NO:956 was selected as the parent enzyme after screening variants described in Example 10. Libraries of engineered genes were produced using well established techniques (e.g., saturation mutagenesis, recombination of previously identified beneficial mutations). The polypeptides encoded by each gene were produced in HTP as described in Example 2, single pellet being obtained, and the soluble lysate was generated as described in Example 3.

To lyse the cells, 200 µl lysis buffer containing 200 mM TEoA buffer, pH 8.5, 1 mg/mL lysozyme, and 0.5 mg/mL PMBS was added to the cell paste. The cells were incubated at room temperature for 2 hours with shaking on a bench top shaker. The plate was then centrifuged for 15 minutes at 4000 rpm and 4° C., and the clear supernatants were used in subsequent biocatalytic reactions.

HTP reactions were carried out in 96-well deep well plates containing 200 µL of 0.2 M TEoA, pH 9, 20 g/L chloro-biphenylpyruvate, 22 g/L L-alanine ethyl ester (~2× molar excess), 10% DMSO, 2 µl above HTP supernatant, with 1 g/L GDH 105, 20 g/L (~110 mM) glucose, 0.1 g/L NAD+. The HTP plates were incubated in Thermotrons (3 mm throw, model #AJ185, Infors) at 30° C., 400 rpm, for 12 hours. The reactions were quenched by acetonitrile at 1:2 ratio, then by 0.1% formic acid in methanol at 1:20 ratio, the supernatant further diluted by water at 1:100 ratio, and then loaded into RapidFire for analysis.

Activity relative to SEQ ID NO:956 was calculated as fold improvement over positive control (FIOPC). It was determined by dividing the product mass spectra signal in each sample by the chloro-biphenylpyruvate ester product mass spectra signal in the parent variant (positive control) present in the same plate under the specified reaction conditions.

TABLE 11.1

Activity of Variant Relative to SEQ ID NO: 956

| SEQ ID NO: (nt/aa) | Amino Acid Differences (Relative to SEQ ID NO: 956) | FIOP Relative to SEQ ID NO: 956 † |
|---|---|---|
| 1061/1062 | R21K/M104L/A160S/S255A/A258P | ++ |
| 1063/1064 | M104L/A160S/N179R | ++ |
| 1065/1066 | M104L/V149E/S255F/A258P/R260Q | ++ |
| 1067/1068 | M104L/A160S | ++ |
| 1069/1070 | M104L/A160S/S178L | ++ |
| 1071/1072 | A258P/R260Q | ++ |
| 1073/1074 | L154K | ++ |
| 1075/1076 | L154Q | ++ |
| 1077/1078 | L174A | ++ |
| 1079/1080 | M104L/N179R | + |
| 1081/1082 | M104L/A258P/R260Q | + |
| 1083/1084 | M104L/S178K/S255F/R260Q | + |
| 1085/1086 | S40T/M104L/S178R/N179R | + |
| 1087/1088 | Q205I/A229S | + |
| 1089/1090 | M104L/S178L/S255F/A258P/R260Q | + |
| 1091/1092 | R21K/S178R/N179R/S255A/R260Q | + |
| 1093/1094 | A197K | + |
| 1095/1096 | Q31H | + |
| 1097/1098 | R21K/M104L/S255A | + |
| 1099/1100 | P3C | + |
| 1101/1102 | Q205T | + |
| 1103/1104 | M104L/S255F/R260Q | + |
| 1105/1106 | K111I/A160S/S255F/R260Q | + |
| 1107/1108 | M104L/V149E/A258P | + |
| 1109/1110 | N46I/E82Q/G259N | + |
| 1111/1112 | K111E/V149E/S255F/A258P | + |
| 1113/1114 | M104L/S178A/N179R/S255A/A258P | + |
| 1115/1116 | P3T | + |
| 1117/1118 | A160S | + |
| 1119/1120 | G253Y | + |
| 1121/1122 | E257R | + |
| 1123/1124 | R260Q | + |
| 1125/1126 | M104L/A160S/S178R/N179R/S255A | + |
| 1127/1128 | R21K/S255A/R260Q | + |
| 1129/1130 | R21K/M104L/S178R/N179R/S255F | + |
| 1131/1132 | A160S/S178L/N179R | + |
| 1133/1134 | L154H | + |
| 1135/1136 | A32M | + |
| 1137/1138 | Q205L | + |
| 1139/1140 | R21K/M104L/S255F/A258P | + |

TABLE 11.1-continued

Activity of Variant Relative to SEQ ID NO: 956

| SEQ ID NO: (nt/aa) | Amino Acid Differences (Relative to SEQ ID NO: 956) | FIOP Relative to SEQ ID NO: 956 † |
|---|---|---|
| 1141/1142 | V156A | + |
| 1143/1144 | R21K/M104L/A160S/S178L/N179R | + |
| 1145/1146 | R21K/M104L/S178R/S255F/A258P | + |
| 1147/1148 | S40K | + |
| 1149/1150 | T194L | + |
| 1151/1152 | E222F | + |
| 1153/1154 | L154W | + |
| 1155/1156 | K111L/A160S/S178A/N179R/S255A/A258P/R260Q | + |
| 1157/1158 | S40T/A160S/S178L | + |
| 1159/1160 | V156T | + |
| 1161/1162 | E103K | + |
| 1163/1164 | M104L/A160S/S178A/S255A/R260Q | + |
| 1165/1166 | M104L/A160S/S178K/N179R/R260Q | + |
| 1167/1168 | K111E/V149E/S255F/R260Q | + |
| 1169/1170 | Q205M | + |

† Levels of increased activity were determined relative to the reference polypeptide of SEQ ID NO: 956 and defined as follows: "+" 1.2 to 1.4, "++" >1.4

Example 12

Improvements in Activity in GDH Relative to SEQ ID NO:1062

SEQ ID NO:1062 was selected as the parent enzyme after screening variants described in Example 11. Libraries of engineered genes were produced using well established techniques (e.g., saturation mutagenesis, recombination of previously identified beneficial mutations). The polypeptides encoded by each gene were produced in HTP as described in Example 2, single pellet being obtained, and the soluble lysate was generated as described in Example 3.

To lyse the cells, 200 µl lysis buffer containing 200 mM TEoA buffer, pH 8.5, 1 mg/mL lysozyme, and 0.5 mg/mL PMBS was added to the cell paste. The cells were incubated at room temperature for 2 hours with shaking on a bench top shaker. The plate was then centrifuged for 15 minutes at 4000 rpm and 4° C., and the clear supernatants were used in subsequent biocatalytic reactions.

HTP reactions were carried out in 96-well deep well plates containing 200 µL of 0.2 M TEoA, pH 9, 20 g/L chloro-biphenylpyruvate, 22 g/L L-alanine ethyl ester (~2× molar excess), 10% DMSO, 2 µl (for 12 hr reaction at 30C) or 10 uL (for 1.5 hr reaction at 45C) above HTP supernatant, with 1 g/L GDH 105, 20 g/L (~110 mM) glucose, 0.1 g/L NAD+. The HTP plates were incubated in Thermotrons (3 mm throw, model #AJ185, Infors) at 30 or 45° C., 400 rpm, for 1.5 hours or for 12 hours. The reactions were quenched by acetonitrile at 1:2 ratio, then by 0.1% formic acid in methanol at 1:20 ratio, the supernatant further diluted by water at 1:100 ratio, and then loaded into RapidFire for analysis.

Activity relative to SEQ ID NO: 1062 was calculated as fold improvement over positive control (FIOPC). It was determined by dividing the product mass spectra signal in each sample by the chloro-biphenylpyruvate ester product mass spectra signal in the parent variant (positive control) present in the same plate under the specified reaction conditions.

TABLE 12.1

Activity of Variant Relative to SEQ ID NO: 1062

| SEQ ID NO: (nt/aa) | Amino Acid Differences (Relative to SEQ ID NO: 1062) | FIOP Relative to SEQ ID NO: 1062 † |
|---|---|---|
| 1171/1172 | Q63M/V156A/Q205T | +++ |
| 1173/1174 | L154H/L174A | +++ |
| 1175/1176 | L154Q/Q205I/G253Y | +++ |
| 1177/1178 | L154W/Q205T | +++ |
| 1179/1180 | L154K/L174A/Q205L/A229S | +++ |
| 1181/1182 | V149E/L154S/Q205L | +++ |
| 1183/1184 | L154K/G253Y | +++ |
| 1185/1186 | Q63M/L154H/Q205L/A229S | +++ |
| 1187/1188 | L154W/Q205I | +++ |
| 1189/1190 | Q205L | +++ |
| 1191/1192 | L154W/Q205T/G253Y | +++ |
| 1193/1194 | L154H/Q205L/G253Y | +++ |
| 1195/1196 | Q63M/Q205M/G253Y | +++ |
| 1197/1198 | Q63M/Q205T/G253Y | +++ |
| 1199/1200 | G253Y | +++ |
| 1201/1202 | Q63M/Q205L | +++ |
| 1203/1204 | Q63M/L154H/S178K/Q205I/G253Y | +++ |
| 1205/1206 | L154W/Q205L | +++ |
| 1207/1208 | Q63M/L154W/S178K/Q205L/G253Y | +++ |
| 1209/1210 | S40T/L154Q/Q205T | ++ |
| 1211/1212 | Q63M/L154W/Q205T | ++ |
| 1213/1214 | Q63M/V149E/Q205L | ++ |
| 1215/1216 | Q63M/L154K/Q205T/G253Y | ++ |
| 1217/1218 | L154K/Q205I | ++ |
| 1219/1220 | Q63M/V149E/Q205L/G253Y | ++ |
| 1221/1222 | L154W/L174A/S178K/Q205T | ++ |
| 1223/1224 | T194H | ++ |
| 1225/1226 | D208L | ++ |
| 1227/1228 | V156A/Q205M/G253Y | ++ |
| 1229/1230 | Q205T/A229S | ++ |
| 1231/1232 | Q63M | ++ |
| 1233/1234 | Q205M | ++ |
| 1235/1236 | V149E/Q205T | ++ |
| 1237/1238 | Q63M/V156A | ++ |
| 1239/1240 | Q205T/A229S/G253Y | ++ |
| 1241/1242 | K54E/Q205M/G253Y | ++ |
| 1243/1244 | Q63M/V149E/V156T/S178K/Q205L/G253Y | ++ |
| 1245/1246 | L154W | ++ |
| 1247/1248 | L154K | ++ |
| 1249/1250 | L154H | ++ |
| 1251/1252 | L154H/Q205T | ++ |
| 1253/1254 | L154W/Q205M | ++ |
| 1255/1256 | Q63M/L154K/Q205L | ++ |
| 1257/1258 | L154W/G253Y | ++ |
| 1259/1260 | Q63M/V149E/L154K/L174A/S178K/G253Y | ++ |
| 1261/1262 | Q63M/L154Q/Q205I/A229S/G253Y | ++ |
| 1263/1264 | L154W/A229S | ++ |
| 1265/1266 | S40T/Q205T/A229S | ++ |
| 1267/1268 | S160A/Q205L/A229S | ++ |
| 1269/1270 | V149E/Q205M | ++ |
| 1271/1272 | Q31H/L154W/Q205L | ++ |
| 1273/1274 | V149E/V156A/G253Y | ++ |
| 1275/1276 | L154K/S160A/G253Y | ++ |
| 1277/1278 | V149E/L154W | ++ |
| 1279/1280 | S40T/L174A/Q205I/A229S | ++ |
| 1281/1282 | Q31H/A55W/Q205I | ++ |
| 1283/1284 | Q31H/L154Q/Q205L | ++ |
| 1285/1286 | V149E/Q205M/G253Y | + |
| 1287/1288 | S160A/Q205L | + |
| 1289/1290 | Q63M/Q205M | + |
| 1291/1292 | P3L/L154W/Q205L | + |
| 1293/1294 | V156T/Q205T | + |
| 1295/1296 | Q31H/L154W/Q205I/E257R | + |
| 1297/1298 | L154K/S160A | + |
| 1299/1300 | Q205L/E222G | + |
| 1301/1302 | V149E/Q205T/G253D | + |
| 1303/1304 | L154W/Q205T/E222Y | + |
| 1305/1306 | P98Q | + |
| 1307/1308 | Q63M/L154W/Q205M | + |
| 1309/1310 | T67S | + |
| 1311/1312 | L154K/S160A/Q205M | + |

TABLE 12.1-continued

Activity of Variant Relative to SEQ ID NO: 1062

| SEQ ID NO: (nt/aa) | Amino Acid Differences (Relative to SEQ ID NO: 1062) | FIOP Relative to SEQ ID NO: 1062 † |
|---|---|---|
| 1313/1314 | Q31H/A55W/L154W/Q205T | + |
| 1315/1316 | Q63M/Q205T | + |
| 1317/1318 | V156A/A229S/G253Y | + |
| 1319/1320 | Q63M/V149E/Q205T/G253Y | + |
| 1321/1322 | Q31H/L154W/Q205I | + |
| 1323/1324 | L154K/S160A/Q205L | + |
| 1325/1326 | S40K/A55W/Q205L | + |
| 1327/1328 | P3T/Q31H/Q205L | + |
| 1329/1330 | Q63M/V149E/L154W/L174A/Q205T/G253Y | + |
| 1331/1332 | L154K/Q205M | + |
| 1333/1334 | Q31H/Q205I/E222Q | + |
| 1335/1336 | Q63M/L154W | + |
| 1337/1338 | L154W/Q205L/E222R | + |
| 1339/1340 | Q31H/Q205L | + |
| 1341/1342 | Q205T | + |
| 1343/1344 | P3C/Q31H/L154K/Q205M/E257R | + |
| 1345/1346 | L154Q/Q205L/E222R/E257R | + |
| 1347/1348 | Q205T/G253Y | + |
| 1349/1350 | Q205T/E222Y | + |
| 1351/1352 | D208T | + |
| 1353/1354 | S160A/Q205M/A229S | + |
| 1355/1356 | L154W/Q205I/E222G | + |
| 1357/1358 | Q63M/V149E/Q205L/A229S/G253Y | + |
| 1359/1360 | L154W/Q205I/E257R | + |
| 1361/1362 | Q31H/A55W/L154Q/Q205T | + |
| 1363/1364 | D208R | + |
| 1365/1366 | S40T/L154Q/Q205T/E257R | + |
| 1367/1368 | Q63M/G253Y | + |
| 1369/1370 | L154W/Q205T/A229S | + |
| 1371/1372 | L154Q/S160A/Q205L/E222F/E257R | + |
| 1373/1374 | A226C | + |
| 1375/1376 | L154W/Q205T/E222F/E257R | + |
| 1377/1378 | L154Q/Q205M/E257R | + |
| 1379/1380 | Q31H/L154W/Q205L/E257R | + |
| 1381/1382 | Q31H/A55W/L154K/Q205T | + |
| 1383/1384 | S160A | + |

† Levels of increased activity were determined relative to the reference polypeptide of SEQ ID NO: 1062 and defined as follows: "+" 1.30 to 1.50, "++" >1.50, "+++" >2.0

Example 13

Improvements in GDH Activity in pH Controlled Reaction

Improvement of six variants listed in Table 13.1 was also evaluated at preparative scale as follows. Shake flask powder of these variants were produced as described in Example 4. To a 25 mL three-neck vessel equipped with a PTFE-coated magnetic stirring bar and a pH electrode connected to an automatic titrator for pH-controlled addition of base on demand via a feeding tube into the vessel, was charged with 10.5 ml 200 mM TEoA buffer, pH 9 containing 79.88 g/L or 199.7 g/L L-alanine ethyl ester (2 or 5 molar equiv.). Subsequently, 500 g/L chloro-biphenylpyruvate in 1.5 mL DMSO, 10 g/L GDH (SEQ ID NO:4), 350 g/L glucose, 1 g/L NAD+ in 1.5 mL of 200 mM TEoA buffer, pH 9, and 29 mg, 50 mg, or 67 mg GDH variant in 1.5 mL of 200 mM TEoA buffer, pH 9 was added. The automatic titrator maintained the pH at 6.5 by the addition of 1N NaOH, which was continuously recorded. The reaction proceeded for 20 hrs at either 30° C. or 45° C.

Samples were collected at 20 hrs and quenched by 20% triethylamine in acetonitrile at 1:2 ratio. After centrifugation at 4000 rpm at 20° C. for 10 minutes, the supernatant was 250×diluted by 50% acetonitrile and then analyzed by LC-UV described in Example 15. Substrate conversion towards the desired product isomer was calculated based on LC-UV-MS of product standard curve. Productivity of these six GDH variants were calculated using the substrate conversion normalized by the weight percentage of enzyme powder per substrate loading. The improvement was listed in Table 13.1.

TABLE 13.1

GDH Activity in pH-controlled Reaction

| SEQ ID NO: (nt/aa) | Productivity |
|---|---|
| 735/736 | + |
| 907/908 | ++ |
| 955/956 | ++ |
| 1061/1062 | ++ |
| 1271/1272 | +++ |

[1]Productivity was defined as follows: "+" = greater than 100 but less than 500; "++" = greater than 500 but less than 1000; "+++" = greater than 1000.

Additional sequences, SEQ ID NOs: 1385-1388, have been included in the sequence listing for variants across the multiple rounds of evolution that were found to have activity similar to the reference sequence.

Example 14

RapidFire Analytical Detection of GDH Reaction Products

HTP assay mixtures prepared in Examples 5-12 were analyzed for the formation of Chloro-biphenyl-Alanine Ester products by RapidFire SPE-MS/MS, with instrument and parameters described in Table 14.1 below.

TABLE 14.1

RapidFire SPE-MS/MS Conditions for Biphenyl-Alanine Ester Products.

| Agilent RapidFire Conditions | |
|---|---|
| Buffer A | 0.1% formic acid in LC/MS grade water; 1.5 mL/min flow rate |
| Buffer B | 60% 0.1% formic acid in LC/MS grade methanol; 40% LC/MS grade water; 0.8 mL/min flow rate |
| Aqueous wash | Water |
| Organic wash | Acetonitrile |
| SPE cartridge | Agilent RapidFire cartridge C (C18) |
| RF state 1 | 600 ms |
| RF state 2 | 3000 ms |
| RF state 3 | 0 |
| RF state 4 | 4500 ms |
| RF state 5 | 600 ms |

TABLE 14.1-continued

RapidFire SPE-MS/MS Conditions for Biphenyl-Alanine Ester Products.

Agilent Jet Stream Source Parameters

| | |
|---|---|
| Drying gas temperature | 300° C. |
| Drying gas flow | 10 L/min |
| Nebulizer pressure | 45 psi |
| Sheath gas temperature | 350° C. |
| Sheath gas flow | 11 L/min |
| Capillary voltage | +1500 V |
| Nozzle voltage | +2000 V |

Agilent 6470 Triple Quadrupole MRM Parameters

| Compound | Q1 | Q3 | Dwell | Fragmentor | CE | CAV |
|---|---|---|---|---|---|---|
| Product diastereomers | 266.1 | 220.1 | 25 | 70 | 12 | 5 |
| Product diastereomers | 266.1 | 192.1 | 25 | 70 | 12 | 5 |
| Product diastereomers | 266.1 | 146.1 | 25 | 70 | 12 | 5 |

Example 15

LC-UV-MS Analytical Detection of GDH Reaction Products

A handful of samples in Example 5-12 and all samples in Example 13 were analyzed using LC-UV-MS method using the instrumental parameters and conditions shown in Table 15.1 and Table 15.2. They were prepared as dilutions in water and acetonitrile, as described in Example 13. The dilution level was dependent upon the starting conditions for the assay. The mass of the product was used to determine the peak of the product isomers, and the side product and the UV signal was used to quantify the desired product isomer and compare to that of product standards for conversion calculation.

TABLE 15.1

LC-UV-MS Analytical Method (product diastereomer, substrate, and side product)

| | |
|---|---|
| Instrument | Waters Acquity UPLC system equipped with a binary pump and multiple wavelength UV detector coupled to a 3200 Sciex QTrap MS system |
| Column | Phenomenex Onyx Monolithio C18 100 × 3.0 mm (CH0-8158) Gradient (A: 0.1% formic acid in water; B: MeCN) |

| Mobile Phase | Time(min) | % B |
|---|---|---|
| | 0.0 | 10 |
| | 0.5 | 10 |
| | 2.7 | 90 |
| | 2.71 | 10 |
| | 3.5 | 10 |

| | |
|---|---|
| Flow Rate | 1.1 mL/min |
| Run Time | 3.5 min |
| Column Temperature | 45° C. |
| Injection Volume | 10 µL |
| MS Detection | MRM mode with each of the following transitions monitored at 150 msec: 348.8→303.2 (hydrolyzed acid form of Compound (1)); 348.8→257.2 (hydrolyzed acid form of Compound (1), 2); 376.8→331.3 (Compound (1), 1); 376.8→257.2 (Compound (1), 2); 277.3→179.2 (Compound (2) (keto to amine) derivative 1); 277.3→231.2 (Compound (2) (keto to amine) derivative 2). |
| MS Conditions | The eluent was infused into the MS equipped with a TurboV ESI source in positive mode. The ions were measured with following source and trap parameters: MS Polarity: Positive; Ionization: TurboV ESI; Mode: MRM; Curtain gas: 20; CAD gas: high; IonSpray voltage: 5500 V; Temperature: 350° C.; Gas one and Gas two: 50; Declustering potential: 70; Entrance potential: 10; Collision Energy: 30; Collision Exit potential: 3 |
| UV Detection | $\lambda$ = 254 nm, 2 points per second or $\lambda$ = 311 nm, 2 points per second |
| Retention time | Hydrolyzed acid product at 1.83 min; ester (Compound (1)) diastereomer product at 2.5 min; alcohol side product (from keto substrate reduction) at 2.4 min, ketoacid (Compound (2))substrate at 2.9 min |

TABLE 15.2

| | LC-MS Analytical Method (product isomer) | |
|---|---|---|
| Instrument | Waters Acquity UPLC system equipped with a binary pump and multiple wavelength UV detector coupled to a 3200 Sciex QTrap MS system | |
| Column | Agilent Eclipse Plus C18 1.8 um, 50 × 4.6 mm (959941-902) Gradient (A: 0.1% formic acid in water; B: MeCN) | |
| Mobile Phase | Time(min) | % B |
| | 0.0 | 40 |
| | 1.8 | 90 |
| | 2.4 | 90 |
| | 2.41 | 40 |
| | 3.0 | 40 |
| Flow Rate | 1.1 mL/min | |
| Run Time | 3 min | |
| Column Temperature | 45 C | |
| Injection Volume | 10 μL | |
| MS Detection | MRM mode with each of the following transitions monitored at 150 msec: 376.8→331.3 (ester product (Compound (1)) 1); 376.8→257.2 (ester product Compound (1) 2); | |
| MS Conditions | The eluent was infused into the MS equipped with a TurboV ESI source in positive mode. The ions were measured with following source and trap parameters: MS Polarity: Positive; Ionization: TurboV ESI; Mode: MRM: Curtain gas: 20; CAD gas: high; IonSpray voltage: 5500 V; Temperature: 350° C.; Gas one and Gas two: 50; Declustering potential: 70; Entrance potential: 10; Collision Energy: 30; Collision Exit potential: 3 | |
| Retention time | S,s-ester product at 0.96 min; s,r-ester product at 1.1 min | |

All publications, patents, patent applications and other documents cited in this application are hereby incorporated by reference in their entireties for all purposes to the same extent as if each individual publication, patent, patent application or other document were individually indicated to be incorporated by reference for all purposes.

While various specific embodiments have been illustrated and described, it will be appreciated that various changes can be made without departing from the spirit and scope of the invention(s).

SEQUENCE LISTING (1388 sequences)

SEQ ID NO: 1 - DNA, 786 bp, Bacillus subtilis
  Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtcttgaaaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgcacgaagtgattccttggccgttatttgtccactatgcggcaagtaaaggcgggataaagctgatgacagaaacattagcgttggaatacgcgccgaagggcattcgcgtcaataatattgggccaggtgcgatcaacacgccaatcaatgctgaaaaattcgctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacacaatatccttcattccaggcaggccgcggttaa

SEQ ID NO: 2 - protein, 261 aa, Bacillus subtilis
  Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGLENPVPSHEMPLKDWDKVIGTNLTGAFLGSREAIKYFVENDIKGNVINMSSVHEVIPWPLFVHYAASKGGIKLMTETLALEYAPKGIRVNNIGPGAINTPINAEKFADPKQKADVESMIPMGYIGEPEEIAAVAAWLASKEASYVTGITLFADGGMTQYPSFQAGRG

SEQ ID NO: 3 - DNA, 786 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtcttgaaaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgcacgaagtgattccttggccgttatttgtccactatgcggcaagtaaaggcgggatgaagctgatgacaaaaacattagcgttggaatacgcgccgaagggcattcgcgtcaataatattgggccaggtgcgatcaacacgacgatcaatgctgagaaatttgctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggttaa

SEQ ID NO: 4 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGLENPVPSHEMPLKDWDKVIGTNLTGAFLGSREAIKYFVENDIKGNVINMSSVHEVIPWPLFVHYAASKGGMKLMTKTLALEYAPKGIRVNNIGPGAINTTINAEKFADPKQKADVESMIPMGYIGEPEEIAAVAAWLASKEASYVTGITLFADGGMTLYPSFQAGRG

SEQ ID NO: 5 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtcttgaaaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtggctgaagtgattccttggccgttatttgtccactatgcggcaagtaaaggcgggatgaagctgatgacaaaaacattagcgttggaatacgcgccgaagggcattcgcgtcaataatattgggccaggtgcgatcaacacgacgatcaatgctgagaaatttgctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 6 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGLENPVPSHEMPLKDWDKVIGTNLTGAFLGSREAIKYFVENDIKGNVINMSSVAEVIPWPLFVHYAASKGGMKLMTKTLALEYAPKGIRVNNIGPGAINTTINAEKFADPKQKADVESMIPMGYIGEPEEIAAVAAWLASKEASYVTGITLFADGGMTLYPSFQAGRG

SEQ ID NO: 7 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtcttgaaaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgagtgaagtgattccttggccgttatttgtccactatgcggcaagtaaaggcgggatgaagctgatgacaaaaacattagcgttggaatacgcgccgaagggcattcgcgtcaataatattgggccaggtgcgatcaacacgacgatcaatgctgagaaatttgctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 8 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGLENPVPSHEMPLKDWDKVIGTNLTGAFLGSREAIKYFVENDIKGNVINMSSVSEVIPWPLFVHYAASKGGMKLMTKTLALEYAPKGIRVNNIGPGAINTTINAEKFADPKQKADVESMIPMGYIGEPEEIAAVAAWLASKEASYVTGITLFADGGMTLYPSFQAGRG

SEQ ID NO: 9 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtcttgaaaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgcacgaagtgattccttggccgttaaatgtccactatgcggcaagtaaaggcgggatgaagctgatgacaaaaacattagcgttggaatacgcgccgaagggcattcgcgtcaataatattgggccaggtgcgatcaacacgacgatcaatgctgagaaatttgctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 10 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGLENPVPSHEMPLKDWDKVIGTNLTGAFLGSREAIKYFVENDIKGNVINMSSVHEVIPWPLNVHYAASKGGMKLMTKTLALEYAPKGIRVNNIGPGAINTTINAEKFADPKQKADVESMIPMGYIGEPEEIAAVAAWLASKEASYVTGITLFADGGMTLYPSFQAGRG

SEQ ID NO: 11 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtcttgaaaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgcacgaagtgattccttggccgttagcggtccactatgcggcaagtaaaggcgggatgaagctgatgacaaaaacattagcgttggaatacgcgccgaagggcattcgcgtcaataatattgggccaggtgcgatcaacacgacgatcaatgctgagaaatttgctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgcatccttcattccaggcaggccgcggt

SEQ ID NO: 12 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGLENPVPSHEMPLKDWDKVIGTNLTGAFLGSREAIKYFVENDIKGNVINMSSVHEVIPWPLAVHYAASKGGMKLMTKTLALEYAPKGIRVNNIGPGAINTTINAEKFADPKQKADVESMIPMGYIGEPEEIAAVAAWLASKEASYVTGITLFADGGMTLHPSFQAGRG

SEQ ID NO: 13 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtcttgaaaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgattgaagtgattccttggccgttatttgtccactatgcggcaagtaaaggcgggatgaagctgatgacaaaaacattagcgttggaatacgcgccgaagggcattcgcgtcaataatattgggccaggtgcgatcaacacgacgatcaatgctgagaaatttgctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 14 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGLENPVPSHEMPLKDWDKVIGTNLTGAFLGSREAIKYFVENDIKGNVINMSSVIEVIPWPLFVHYAASKGGMKLMTKTLALEYAPKGIRVNNIGPGAINTTINAEKFADPKQKADVESMIPMGYIGEPEEIAAVAAWLASKEASYVTGITLFADGGMTLYPSFQAGRG

SEQ ID NO: 15 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtcttgaaaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgcacgaagtgattccttggccgttatttgtccactatgcggcaagtaaaggcgggatgaagctgatgacaaaaacattagcgttggaatacgcgccgaagggcattcgcgtcaataatattgggccaggtgcgatcaacacgacgatcaatgctgagaaatttgctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcaacgcaggcaggccgcggt

SEQ ID NO: 16 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGLENPVPSHEMPLKDWDKVIGTNLTGAFLGSREAIKYFVENDIKGNVINMSSVHEVIPWPLFVHYAASKGGMKLMTKTLALEYAPKGIRVNNIGPGAINTTINAEKFADPKQKADVESMIPMGYIGEPEEIAAVAAWLASKEASYVTGITLFADGGMTLYPSTQAGRG

SEQ ID NO: 17 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtcttgctaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgcacgaagtgattccttggccgttatttgtccactatgcggcaagtaaaggcgggatgaagctgatgacaaaaacattagcgttggaatacgcgccgaagggcattcgcgtcaataatattgggccaggtgcgatcaacacgacgatcaatgctgagaaatttgctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 18 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGLANPVPSHEMPLKDWDKVIGTNLTGAFLGSREAIKYFVENDIKGNVINMSSVHEVIPWPLFVHYAASKGGMKLMTKTLALEYAPKGIRVNNIGPGAINTTINAEKFADPKQKADVESMIPMGYIGEPEEIAAVAAWLASKEASYVTGITLFADGGMTLYPSFQAGRG

SEQ ID NO: 19 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtctttgtaatcctgtgccatctcacgaaatgccgctcaaggattgggataaagtcatcggcacgaacttaatgggtgcctttttaggaagccgtgaagcgattaaatatttcgtagaaaacgatatcaagggaaatgtcattaacatgtccagtgtgcacgaagtgattccttggccgttatttgtccactatgcggcaagtaaaggcgggatgaagctgatgacaaaaacattagcgttggaatacgcgccgaagggcattcgcgtcaataatattgggccaggtgcgatcaacacgacgatcaatgctgagaaatttgctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 20 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGLCNPVPSHEMPLKDWDKVIGTNLMGAFLGSREAIKYFVENDIKGNVINMSSVHEVIPWPLFVHYAASKGGMKLMTKTLALEYAPKGIRVNNIGPGAINTTINAEKFADPKQKADVESMIPMGYIGEPEEIAAVAAWLASKEASYVTGITLFADGGMTLYPSFQAGRG

SEQ ID NO: 21 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtcttgaaaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgcacgaagtgattccttggccgttatttgtccactatgcggcaagtaaaggcgggatgaagctgatgacaaaaacattagcgttggaatacgcgccgaagggcattcgcgtcaataatattgggccaggtgcgatcaacacgacgatcaatgctgagaaatttgctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcagttcaggcaggccgcggt

SEQ ID NO: 22 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGLENPVPSHEMPLKDWDKVIGTNLTGAFLGSREAIKYFVENDIKGNVINMSSVHEVIPWPLFVHYAASKGGMKLMTKTLALEYAPKGIRVNNIGPGAINTTINAEKFADPKQKADVESMIPMGYIGEPEEIAAVAAWLASKEASYVTGITLFADGGMTLYPSVQAGRG

SEQ ID NO: 23 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtcttgaaaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgcacgaagtgattccttggccgttatttgtccactatgcggcaagtaaaggcgggatgaagctgatgacaaaaacattagcgttggaatacgcgccgaagggcattcgcgtcaataatattgggccaggtgcgatcaacacgacgatcaatgctgagaaatttgctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcaagtcaggcaggccgcggt

SEQ ID NO: 24 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGLENPVPSHEMPLKDWDKVIGTNLTGAFLGSREAIKYFVENDIKGNVINMSSVHEVIPWPLFVHYAASKGGMKLMTKTLALEYAPKGIRVNNIGPGAINTTINAEKFADPKQKADVESMIPMGYIGEPEEIAAVAAWLASKEASYVTGITLFADGGMTLYPSSQAGRG

SEQ ID NO: 25 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtcttgaaaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgcacgaagtgattccttggccgttatttgtccactatgcggcaagtaaaggcgggatgaagctgatgacaaaaacattagcgttggaatacgcgccgaagggcattcgcgtcaataatattgggccaggtgcgatcaacacgacgatcaatgctgagaaatttgctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcagctcaggcaggccgcggt

SEQ ID NO: 26 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGLENPVPSHEMPLKDWDKVIGTNLTGAFLGSREAIKYFVENDIKGNVINMSSVHEVIPWPLFVHYAASKGGMKLMTKTLALEYAPKGIRVNNIGPGAINTTINAEKFADPKQKADVESMIPMGYIGEPEEIAAVAAWLASKEASYVTGITLFADGGMTLYPSAQAGRG

SEQ ID NO: 27 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtcttgaaaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgcacgaagtgattccttggccgttatttgtccactatgcggcaagtaaaggcgggatgaagctgatgacaaaaacattagcgttggaatacgcgccgaagggcattcgcgtcaataatattgggccaggtgcgatcaacacgacgatcaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 28 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGLENPVPSHEMPLKDWDKVIGTNLTGAFLGSREAIKYFVENDIKGNVINMSSVHEVIPWPLFVHYAASKGGMKLMTKTLALEYAPKGIRVNNIGPGAINTTINAEKWADPKQKADVESMIPMGYIGEPEEIAAVAAWLASKEASYVTGITLFADGGMTLYPSFQAGRG

SEQ ID NO: 29 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtcttgaaaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgcacgaagtgattccttggccgttatttgtccactatgcggcaagtaaaggcgggatgaagctgatgacaaaaacattagcgttggaatacgcgccgaagggcattcgcgtcaataatattgggccaggtgcgatcaacacgacggggaatgctgagaaatttgctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 30 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGLENPVPSHEMPLKDWDKVIGTNLTGAFLGSREAIKYFVENDIKGNVINMSSVHEVIPWPLFVHYAASKGGMKLMTKTLALEYAPKGIRVNNIGPGAINTTGNAEKFADPKQKADVESMIPMGYIGEPEEIAAVAAWLASKEASYVTGITLFADGGMTLYPSFQAGRG

SEQ ID NO: 31 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtcttgaaaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgattgaagtgattccttggccgttaagggtccactatgcggcaagtaaaggcgggatgaagctgatgacaaaaacattagcgttggaatacgcgccgaagggcattcgcgtcaataatattgggccaggtgcgatcaacacgacgatcaatgctgagaaatttgctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 32 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGLENPVPSHEMPLKDWDKVIGTNLTGAFLGSREAIKYFVENDIKGNVINMSSVIEVIPWPLRVHYAASKGGMKLMTKTLALEYAPKGIRVNNIGPGAINTTINAEKFADPKQKADVESMIPMGYIGEPEEIAAVAAWLASKEASYVTGITLFADGGMTLYPSFQAGRG

SEQ ID NO: 33 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 34 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTINAEKWADPKQKADVESMIPMGYIGEPEEIAAVAAWLASKEASYVTGITLFADGGMTLYPSFQAGRG

SEQ ID NO: 35 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtcttgaaaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgattgaagtgattccttggccgttaaatacgcactatgccgcaagtaaaggcgggatgaagctgatgacaaaaacattagcgttggaatacgcgccgaagggcattcgcgtcaataatattgggccaggtgcgatcaacacgacgggtaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgcacccttcattccaggcaggccgcggt

SEQ ID NO: 36 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGLENPVPSHEMPLKDWDKVIGTNLTGAFLGSREAIKYFVENDIKGNVINMSSVIEVIPWPLNTHYAASKGGMKLMTKTLALEYAPKGIRVNNIGPGAINTTGNAEKWADPKQKADVESMIPMGYIGEPEEIAAVAAWLASKEASYVTGITLFADGGMTLHPSFQAGRG

SEQ ID NO: 37 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgattgaagtgattccttggccgttaaatgcccactatgccgcaagtaaaggcgggatgaagctgatgacaaaaacattagcgttggaatacgcgccgaagggcattcgcgtcaataatattgggccaggtgcgatcaacacgacgatcaatgctgagaaatttgctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtacccttcattccaggcaggccgcggt

SEQ ID NO: 38 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLNAHYAASKGGMKLMTKTLALEYAPKGIRVNNIGPGAINTTINAEKFADPKQKADVESMIPMGYIGEPEEIAAVAAWLASKEASYVTGITLFADGGMTLYPSFQAGRG

SEQ ID NO: 39 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtcttgaaaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgatcaatgctgagaaatttgctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 40 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGLENPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTINAEKFADPKQKADVESMIPMGYIGEPEEIAAVAAWLASKEASYVTGITLFADGGMTLYPSFQAGRG

SEQ ID NO: 41 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtctgcaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttattcgtccactataccgcaagtaaaggcgggatgaagctgatgacaaaaacattagcgttggaatacgcgccgaagggcattcgcgtcaataatattgggccaggtgcgatcaacacgacgggtaatgctgagaaatttgctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgcacccttcattccaggcaggccgcggt

SEQ ID NO: 42 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVCNPVPSHEMPLKDWDKVIGTNLTGAFLGSREAIKYFVENDIKGNVINMSSVIEVIPWPLFVHYTASKGGMKLMTKTLALEYAPKGIRVNNIGPGAINTTGNAEKFADPKQKADVESMIPMGYIGEPEEIAAVAAWLASKEASYVTGITLFADGGMTLHPSFQAGRG

SEQ ID NO: 43 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtcttgaaaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgattgaagtgattccttggccgttacaggtccactatgcggcaagtaaaggcgggatgaagctgatgacaaaaacattagcgttggaatacgcgccgaagggcattcgcgtcaataatattgggccaggtgcgatcaacacgacgatcaatgctgagaaatttgctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 44 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGLENPVPSHEMPLKDWDKVIGTNLTGAFLGSREAIKYFVENDIKGNVINMSSVIEVIPWPLQVHYAASKGGMKLMTKTLALEYAPKGIRVNNIGPGAINTTINAEKFADPKQKADVESMIPMGYIGEPEEIAAVAAWLASKEASYVTGITLFADGGMTLYPSFQAGRG

SEQ ID NO: 45 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtctgtgcaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgattgaagtgattccttggccgttaaatgtccactataccgcaagtaaaggcgggatgaagctgatgacaaaaacattagcgttggaatacgcgccgaagggcattcgcgtcaataatattgggccaggtgcgatcaacacgacgatcaatgctgagaaatttgctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtacccttcattccaggcaggccgcggt

SEQ ID NO: 46 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGLCNPVPSHEMPLKDWDKVIGTNLTGAFLGSREAIKYFVENDIKGNVINMSSVIEVIPWPLNVHYTASKGGMKLMTKTLALEYAPKGIRVNNIGPGAINTTINAEKFADPKQKADVESMIPMGYIGEPEEIAAVAAWLASKEASYVTGITLFADGGMTLYPSFQAGRG

SEQ ID NO: 47 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtcttgaaaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgattgaagtgattccttggccgttaaatgcccactatgccgcaagtaaaggcgggatgaagctgatgacaaaaacattagcgttggaatacgcgccgaagggcattcgcgtcaataatattgggccaggtgcgatcaacacgacgattaatgctgagaaatttgctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtacccttcattccaggcaggccgcggt

SEQ ID NO: 48 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGLENPVPSHEMPLKDWDKVIGTNLTGAFLGSREAIKYFVENDIKGNVINMSSVIEVIPWPLNAHYAASKGGMKLMTKTLALEYAPKGIRVNNIGPGAINTTINAEKFADPKQKADVESMIPMGYIGEPEEIAAVAAWLASKEASYVTGITLFADGGMTLYPSFQAGRG

SEQ ID NO: 49 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactattgtgcaagtaaaggcgggatgaagctgatgacaaaaacattagcgttggaatacgcgccgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 50 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLNVHYCASKGGMKLMTKTLALEYAPKGIRVNNIGPGAINTTINAEKWADPKQKADVESMIPMGYIGEPEEIAAVAAWLASKEASYVTGITLFADGGMTLYPSFQAGRG

SEQ ID NO: 51 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgcgaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgcaagaagtgattccttggccgttattcgtccactatgccgcaagtaaaggcgggatgaagctgatgacaaaaacattagcgttggaatacgcgccgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgcacccttcattccaggcaggccgcggt

SEQ ID NO: 52 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVANPVPSHEMPLKDWDKVIGTNLTGAFLGSREAIKYFVENDIKGNVINMSSVQEVIPWPLFVHYAASKGGMKLMTKTLALEYAPKGIRVNNIGPGAINTTINAEKWADPKQKADVESMIPMGYIGEPEEIAAVAAWLASKEASYVTGITLFADGGMTLHPSFQAGRG

SEQ ID NO: 53 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtcttgaaaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgcaagaagtgattccttggccgttaaatgcccactatgccgcaagtaaaggcgggatgaagctgatgacaaaaacattagcgttggaatacgcgccgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtacccttcattccaggcaggccgcggt

SEQ ID NO: 54 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGLENPVPSHEMPLKDWDKVIGTNLTGAFLGSREAIKYFVENDIKGNVINMSSVQEVIPWPLNAHYAASKGGMKLMTKTLALEYAPKGIRVNNIGPGAINTTINAEKWADPKQKADVESMIPMGYIGEPEEIAAVAAWLASKEASYVTGITLFADGGMTLYPSFQAGRG

SEQ ID NO: 55 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtctggcgaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgcaagaagtgattccttggccgttatttgtccactatgcggcaagtaaaggcgggatgaagctgatgacaaaaacattagcgttggaatacgcgccgaagggcattcgcgtcaataatattgggccaggtgcgatcaacacgacgggtaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgcacccttcattccaggcaggccgcggt

SEQ ID NO: 56 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGLANPVPSHEMPLKDWDKVIGTNLTGAFLGSREAIKYFVENDIKGNVINMSSVQEVIPWPLFVHYAASKGGMKLMTKTLALEYAPKGIRVNNIGPGAINTTGNAEKWADPKQKADVESMIPMGYIGEPEEIAAVAAWLASKEASYVTGITLFADGGMTLHPSFQAGRG

SEQ ID NO: 57 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtctgtgcaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactattgtgcaagtaaaggcgggatgaagctgatgacaaaaacattagcgttggaatacgcgccgaagggcattcgcgtcaataatattgggccaggtgcgatcaacacgacgggtaatgctgagaaatttgctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 58 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGLCNPVPSHEMPLKDWDKVIGTNLTGAFLGSREAIKYFVENDIKGNVINMSSVIEVIPWPLNVHYCASKGGMKLMTKTLALEYAPKGIRVNNIGPGAINTTGNAEKFADPKQKADVESMIPMGYIGEPEEIAAVAAWLASKEASYVTGITLFADGGMTLYPSFQAGRG

SEQ ID NO: 59 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgcgaatcctgtgccatctcacgaaatgccgctcaaggattgggataaagtcatcggcacgaacttaatgggtgcctttttaggaagccgtgaagcgattaaatatttcgtagaaaacgatatcaagggaaatgtcattaacatgtccagtgtgatcgaagtgattccttggccgttattcacgcactatgccgcaagtaaaggcgggatgaagctgatgacaaaaacattagcgttggaatacgcgccgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgcacccttcattccaggcaggccgcggt

SEQ ID NO: 60 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVANPVPSHEMPLKDWDKVIGTNLMGAFLGSREAIKYFVENDIKGNVINMSSVIEVIPWPLFTHYAASKGGMKLMTKTLALEYAPKGIRVNNIGPGAINTTINAEKWADPKQKADVESMIPMGYIGEPEEIAAVAAWLASKEASYVTGITLFADGGMTLHPSFQAGRG

SEQ ID NO: 61 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtcttagtaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgattgaagtgattccttggccgttatttgtccactatgcggcaagtaaaggcgggatgaagctgatgacaaaaacattagcgttggaatacgcgccgaagggcattcgcgtcaataatattgggccaggtgcgatcaacacgacgatcaatgctgagaaatttgctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 62 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGLSNPVPSHEMPLKDWDKVIGTNLTGAFLGSREAIKYFVENDIKGNVINMSSVIEVIPWPLFVHYAASKGGMKLMTKTLALEYAPKGIRVNNIGPGAINTTINAEKFADPKQKADVESMIPMGYIGEPEEIAAVAAWLASKEASYVTGITLFADGGMTLYPSFQAGRG

SEQ ID NO: 63 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtctgcaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgcaagaagtgattccttggccgttatttgtccactatgcggcaagtaaaggcgggatgaagctgatgacaaaaacattagcgttggaatacgcgccgaagggcattcgcgtcaataatattgggccaggtgcgatcaacacgacgatcaatgctgagaaatttgctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtacccttcattccaggcaggccgcggt

SEQ ID NO: 64 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVCNPVPSHEMPLKDWDKVIGTNLTGAFLGSREAIKYFVENDIKGNVINMSSVQEVIPWPLFVHYAASKGGMKLMTKTLALEYAPKGIRVNNIGPGAINTTINAEKFADPKQKADVESMIPMGYIGEPEEIAAVAAWLASKEASYVTGITLFADGGMTLYPSFQAGRG

SEQ ID NO: 65 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtctgcaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgattgaagtgattccttggccgttagccgtccactatgccgcaagtaaaggcgggatgaagctgatgacaaaaacattagcgttggaatacgcgccgaagggcattcgcgtcaataatattgggccaggtgcgatcaacacgacgggtaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 66 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVCNPVPSHEMPLKDWDKVIGTNLTGAFLGSREAIKYFVENDIKGNVINMSSVIEVIPWPLAVHYAASKGGMKLMTKTLALEYAPKGIRVNNIGPGAINTTGNAEKWADPKQKADVESMIPMGYIGEPEEIAAVAAWLASKEASYVTGITLFADGGMTLYPSFQAGRG

SEQ ID NO: 67 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtctgtgcaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgattgaagtgattccttggccgttattcgcccactataccgcaagtaaaggcgggatgaagctgatgacaaaaacattagcgttggaatacgcgccgaagggcattcgcgtcaataatattgggccaggtgcgatcaacacgacgggtaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 68 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGLCNPVPSHEMPLKDWDKVIGTNLTGAFLGSREAIKYFVENDIKGNVINMSSVIEVIPWPLFAHYTASKGGMKLMTKTLALEYAPKGIRVNNIGPGAINTTGNAEKWADPKQKADVESMIPMGYIGEPEEIAAVAAWLASKEASYVTGITLFADGGMTLYPSFQAGRG

SEQ ID NO: 69 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtctgtgcaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgattgaagtgattccttggccgttaaatgtccactattgtgcaagtaaaggcgggatgaagctgatgacaaaaacattagcgttggaatacgcgccgaagggcattcgcgtcaataatattgggccaggtgcgatcaacacgacgatcaatgctgagaaatttgctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtacccttcattccaggcaggccgcggt

SEQ ID NO: 70 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGLCNPVPSHEMPLKDWDKVIGTNLTGAFLGSREAIKYFVENDIKGNVINMSSVIEVIPWPLNVHYCASKGGMKLMTKTLALEYAPKGIRVNNIGPGAINTTINAEKFADPKQKADVESMIPMGYIGEPEEIAAVAAWLASKEASYVTGITLFADGGMTLYPSFQAGRG

SEQ ID NO: 71 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtctgcaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgattgaagtgattccttggccgttatttgtccactatgcggcaagtaaaggcgggatgaagctgatgacaaaaacattagcgttggaatacgcgccgaagggcattcgcgtcaataatattgggccaggtgcgatcaacacgacgatcaatgctgagaaatttgctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 72 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVCNPVPSHEMPLKDWDKVIGTNLTGAFLGSREAIKYFVENDIKGNVINMSSVIEVIPWPLFVHYAASKGGMKLMTKTLALEYAPKGIRVNNIGPGAINTTINAEKFADPKQKADVESMIPMGYIGEPEEIAAVAAWLASKEASYVTGITLFADGGMTLYPSFQAGRG

SEQ ID NO: 73 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtctgtgcaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgattgaagtgattccttggccgttattcctgcactataccgcaagtaaaggcgggatgaagctgatgacaaaaacattagcgttggaatacgcgccgaagggcattcgcgtcaataatattgggccaggtgcgatcaacacgacgggtaatgctgagaaatttgctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtacccttcattccaggcaggccgcggt

SEQ ID NO: 74 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGLCNPVPSHEMPLKDWDKVIGTNLTGAFLGSREAIKYFVENDIKGNVINMSSVIEVIPWPLFLHYTASKGGMKLMTKTLALEYAPKGIRVNNIGPGAINTTGNAEKFADPKQKADVESMIPMGYIGEPEEIAAVAAWLASKEASYVTGITLFADGGMTLYPSFQAGRG

SEQ ID NO: 75 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtctgcaatcctgtgccatctcacgaaatgccgctcaaggattgggataaagtcatcggcacgaacttaatgggtgcctttttaggaagccgtgaagcgattaaatatttcgtagaaaacgatatcaagggaaatgtcattaacatgtccagtgtgattgaagtgattccttggccgttatttgtccactatgcggcaagtaaaggcgggatgaagctgatgacaaaaacattagcgttggaatacgcgccgaagggcattcgcgtcaataatattgggccaggtgcgatcaacacgacgatcaatgctgagaaatttgctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 76 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVCNPVPSHEMPLKDWDKVIGTNLMGAFLGSREAIKYFVENDIKGNVINMSSVIEVIPWPLFVHYAASKGGMKLMTKTLALEYAPKGIRVNNIGPGAINTTINAEKFADPKQKADVESMIPMGYIGEPEEIAAVAAWLASKEASYVTGITLFADGGMTLYPSFQAGRG

SEQ ID NO: 77 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtctgcaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgcaagaagtgattccttggccgttatttgtccactatgcggcaagtaaaggcgggatgaagctgatgacaaaaacattagcgttggaatacgcgccgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtacccttcattccaggcaggccgcggt

SEQ ID NO: 78 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVCNPVPSHEMPLKDWDKVIGTNLTGAFLGSREAIKYFVENDIKGNVINMSSVQEVIPWPLFVHYAASKGGMKLMTKTLALEYAPKGIRVNNIGPGAINTTINAEKWADPKQKADVESMIPMGYIGEPEEIAAVAAWLASKEASYVTGITLFADGGMTLYPSFQAGRG

SEQ ID NO: 79 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtcttgaaaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgactgaagtgattccttggccgttatttgtccactatgcggcaagtaaaggcgggatgaagctgatgacaaaaacattagcgttggaatacgcgccgaagggcattcgcgtcaataatattgggccaggtgcgatcaacacgacgatcaatgctgagaaatttgctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 80 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGLENPVPSHEMPLKDWDKVIGTNLTGAFLGSREAIKYFVENDIKGNVINMSSVTEVIPWPLFVHYAASKGGMKLMTKTLALEYAPKGIRVNNIGPGAINTTINAEKFADPKQKADVESMIPMGYIGEPEEIAAVAAWLASKEASYVTGITLFADGGMTLYPSFQAGRG

SEQ ID NO: 81 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtctgcaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaaccagcactatgccgcaagtaaaggcgggatgaagctgatgacaaaaacattagcgttggaatacgcgccgaagggcattcgcgtcaataatattgggccaggtgcgatcaacacgacgattaatgctgagaaatttgctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 82 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVCNPVPSHEMPLKDWDKVIGTNLTGAFLGSREAIKYFVENDIKGNVINMSSVIEVIPWPLNQHYAASKGGMKLMTKTLALEYAPKGIRVNNIGPGAINTTINAEKFADPKQKADVESMIPMGYIGEPEEIAAVAAWLASKEASYVTGITLFADGGMTLYPSFQAGRG

SEQ ID NO: 83 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtctgtgcaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgattgaagtgattccttggccgttaaatgtccactattgtgcaagtaaaggcgggatgaagctgatgacaaaaacattagcgttggaatacgcgccgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 84 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGLCNPVPSHEMPLKDWDKVIGTNLTGAFLGSREAIKYFVENDIKGNVINMSSVIEVIPWPLNVHYCASKGGMKLMTKTLALEYAPKGIRVNNIGPGAINTTINAEKWADPKQKADVESMIPMGYIGEPEEIAAVAAWLASKEASYVTGITLFADGGMTLYPSFQAGRG

SEQ ID NO: 85 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtcttgaaaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgcaagaagtgattccttggccgttattcgtccactatgccgcaagtaaaggcgggatgaagctgatgacaaaaacattagcgttggaatacgcgccgaagggcattcgcgtcaataatattgggccaggtgcgatcaacacgacgggtaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgcacccttcattccaggcaggccgcggt

SEQ ID NO: 86 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGLENPVPSHEMPLKDWDKVIGTNLTGAFLGSREAIKYFVENDIKGNVINMSSVQEVIPWPLFVHYAASKGGMKLMTKTLALEYAPKGIRVNNIGPGAINTTGNAEKWADPKQKADVESMIPMGYIGEPEEIAAVAAWLASKEASYVTGITLFADGGMTLHPSFQAGRG

SEQ ID NO: 87 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtctgtgcaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttatttgtccactatgcggcaagtaaaggcgggatgaagctgatgacaaaaacattagcgttggaatacgcgccgaagggcattcgcgtcaataatattgggccaggtgcgatcaacacgacgggtaatgctgagaaatttgctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 88 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGLCNPVPSHEMPLKDWDKVIGTNLTGAFLGSREAIKYFVENDIKGNVINMSSVIEVIPWPLFVHYAASKGGMKLMTKTLALEYAPKGIRVNNIGPGAINTTGNAEKFADPKQKADVESMIPMGYIGEPEEIAAVAAWLASKEASYVTGITLFADGGMTLYPSFQAGRG

SEQ ID NO: 89 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtcttgaaaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgcaagaagtgattccttggccgttaaatgtccactattgtgcaagtaaaggcgggatgaagctgatgacaaaaacattagcgttggaatacgcgccgaagggcattcgcgtcaataatattgggccaggtgcgatcaacacgacgattaatgctgagaaatttgctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 90 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGLENPVPSHEMPLKDWDKVIGTNLTGAFLGSREAIKYFVENDIKGNVINMSSVQEVIPWPLNVHYCASKGGMKLMTKTLALEYAPKGIRVNNIGPGAINTTINAEKFADPKQKADVESMIPMGYIGEPEEIAAVAAWLASKEASYVTGITLFADGGMTLYPSFQAGRG

SEQ ID NO: 91 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtcttgaaaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgcaagaagtgattccttggccgttaaatacgcactatgccgcaagtaaaggcgggatgaagctgatgacaaaaacattagcgttggaatacgcgccgaagggcattcgcgtcaataatattgggccaggtgcgatcaacacgacgattaatgctgagaaatttgctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtacccttcattccaggcaggccgcggt

SEQ ID NO: 92 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGLENPVPSHEMPLKDWDKVIGTNLTGAFLGSREAIKYFVENDIKGNVINMSSVQEVIPWPLNTHYAASKGGMKLMTKTLALEYAPKGIRVNNIGPGAINTTINAEKFADPKQKADVESMIPMGYIGEPEEIAAVAAWLASKEASYVTGITLFADGGMTLYPSFQAGRG

SEQ ID NO: 93 - DNA, 783 bp, Artificial Sequence
  Variant of Glucose Dehydrogenase from Bacillus subtilis
atgtatccggatttaaaaggaaaagtcgtcgctattacaggagctgctactgggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtcttgaaaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgattgaagtgattccttggccgttatttgtccactatgcggcaagtaaaggcgggatgaagctgatgacaaaaacattagcgttggaatacgcgccgaagggcattcgcgtcaataatattgggccaggtgcgatcaacacgacgatcaatgctgagaaatttgctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 94 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNEVKEEVIKAGGEAVVVQGDVTKEEDVKNIVQTAIKEFGTLDIMINNAGLENPVPSHEMPLKDWDKVIGTNLTGAFLGSREAIKYFVENDIKGNVINMSSVIEVIPWPLFVHYAASKGGMKLMTKTLALEYAPKGIRVNNIGPGAINTTINAEKFADPKQKADVESMIPMGYIGEPEEIAAVAAWLASKEASYVTGITLFADGGMTLYPSFQAGRG

SEQ ID NO: 95 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtcttgaaaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgcaagaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgatcaatgctgagaaatttgctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 96 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGLENPVPSHEMPLKDWDKVIGTNLTGAFLGSREAIKYFVENDIKGNVINMSSVQEVIPWPLNVHYAASKGGMKLMTKTLALEYAPKGIRVNNIGPGAINTTINAEKFADPKQKADVESMIPMGYIGEPEEIAAVAAWLASKEASYVTGITLFADGGMTLYPSFQAGRG

SEQ ID NO: 97 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtctgtgcaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttagccgtccactatgccgcaagtaaaggcgggatgaagctgatgacaaaaacattagcgttggaatacgcgccgaagggcattcgcgtcaataatattgggccaggtgcgatcaacacgacgatcaatgctgagaaatttgctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 98 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGLCNPVPSHEMPLKDWDKVIGTNLTGAFLGSREAIKYFVENDIKGNVINMSSVIEVIPWPLAVHYAASKGGMKLMTKTLALEYAPKGIRVNNIGPGAINTTINAEKFADPKQKADVESMIPMGYIGEPEEIAAVAAWLASKEASYVTGITLFADGGMTLYPSFQAGRG

SEQ ID NO: 99 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtcttgaaaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgattgaagtgattccttggccgttatttgtccactatgcggcaagtaaaggcgggatgaagctgatgacaaaaacattagcgttggaatacgcgccgaagggcattcgcgtcaataatattgggccaggtgcgatcaacacgacgatcaatgctgagaaatttgctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactggggccttcattccaggcaggccgcggt

SEQ ID NO: 100 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGLENPVPSHEMPLKDWDKVIGTNLTGAFLGSREAIKYFVENDIKGNVINMSSVIEVIPWPLFVHYAASKGGMKLMTKTLALEYAPKGIRVNNIGPGAINTTINAEKFADPKQKADVESMIPMGYIGEPEEIAAVAAWLASKEASYVTGITLFADGGMTLGPSFQAGRG

SEQ ID NO: 101 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtcttgaaaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgattgaagtgattccttggccgttatttgtccactatgcggcaagtaaaggcgggatgaagctgatgacaaaaacattagcgttggaatacgcgccgaagggcattcgcgtcaataatattgggccaggtgcgatcaacacgacgatcaatgctgagaaatttgctgaccctaaacagaaagctgatgtagaaagcatgattccaatgggatatatcggcgaaccggaggagatcgccgcagtagcagcctggcttgcttcgaaggaagccagctatgtcacaggcatcacgttattcgcggacggcggtatgacactgagtccttcattccaggcaggccgcggt

SEQ ID NO: 102 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGLENPVPSHEMPLKDWDKVIGTNLTGAFLGSREAIKYFVENDIKGNVINMSSVIEVIPWPLFVHYAASKGGMKLMTKTLALEYAPKGIRVNNIGPGAINTTINAEKFADPKQKADVESMIPMGYIGEPEEIAAVAAWLASKEASYVTGITLFADGGMTLSPSFQAGRG

SEQ ID NO: 103 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtctggagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactattgtgcaagtaaaggcgggatgaagctgatgacaaaaacattagcgttggaatacgcgccgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 104 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGLENPVPSHEMPLKDWDKVIGTNLTGAFLGSREAIKYFVENDIKGNVINMSSVIEVIPWPLNVHYCASKGGMKLMTKTLALEYAPKGIRVNNIGPGAINTTINAEKWADPKQKADVESMIPMGYIGEPEEIAAVAAWLASKEASYVTGITLFADGGMTLYPSFQAGRG

SEQ ID NO: 105 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacgcggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcaccaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgactgaagtgattccttggccgttaaacgtccactatgccgcaagtaaaggcgggatgaagctgatgacaaaaacattagcgttggaatacgcgccgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgggtccttcattccaggcaggccgcggt

SEQ ID NO: 106 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNAVKEEVIKAGGEAVVVQGDVTKEEDVKNIVQTAIKEFGTLDIMINNAGVTNPVPSHEMPLKDWDKVIGTNLTGAFLGSREAIKYFVENDIKGNVINMSSVTEVIPWPLNVHYAASKGGMKLMTKTLALEYAPKGIRVNNIGPGAINTTGNAERWADPKQKADVESMIPMGYIGEPEEIAAVAAWLASKEASYVTGITLFADGGMTLGPSFQAGRG

SEQ ID NO: 107 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaaaacccgaacctggtaaaagaagcggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgcaaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgactgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgggtccttcattccaggcaggccgcggt

SEQ ID NO: 108 - protein, 261 aa, Artificial Sequence
  Variant of Glucose Dehydrogenase from Bacillus subtilis
MYPDLKGKVVAITGAATGLGKAMAIRFGKEQAKVVINYYSNKQNPNLVKEAVIKAGGEAVVVQGDVTKEEDVKNIVQTAIKEFGTLDIMINNAGVANPVPSHEMPLKDWDKVIATNLTGAFLGSREAIKYFVENDIKGNVINMSSVTEVIPWPLNVHYAASKGGMKLMTKTLALEYAPKGIRVNNIGPGAINTTGNAERWADPKQKADVESMIPMGYIGEPEEIAAVAAWLASKEASYVTGITLFADGGMTLGPSFQAGRG

SEQ ID NO: 109 - DNA, 783 bp, Artificial Sequence
  Variant of Glucose Dehydrogenase from Bacillus subtilis
atgtatccggatttaaaaggaaaagtcgtcgctattacaggagctgctagcgggctcggaaaggcgatggccattcgcttcggcaaggagcaggcaaaagtggttatcaactattatagtaataaacaaaacccgtgggaggtaaaagaagcggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgcaaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgactgaagtgattccttggccgttaaatgtccactatgccgcaagtaaaggcgggatgaagctgatgacaaaaacattagcgttggaatacgcgtcgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 110 - protein, 261 aa, Artificial Sequence
  Variant of Glucose Dehydrogenase from Bacillus subtilis
MYPDLKGKVVAITGAASGLGKAMAIRFGKEQAKVVINYYSNKQNPWEVKEAVIKAGGEAVVVQGDVTKEEDVKNIVQTAIKEFGTLDIMINNAGVANPVPSHEMPLKDWDKVIGTNLTGAFLGSREAIKYFVENDIKGNVINMSSVTEVIPWPLNVHYAASKGGMKLMTKTLALEYASKGIRVNNIGPGAINTTGNAERWADPKQKADVESMIPMGYIGEPEEIAAVAAWLASKEASYVTGITLFADGGMTLYPSFQAGRG

SEQ ID NO: 111 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgatcgaagtgattccttggccgttacgcgtccactatgccgcaagtaaaggcgggatgaagctgatgacaaaaacattagcgttggaatacgcgccgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgagtccttcattccaggcaggccgcggt

SEQ ID NO: 112 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNLVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVIEVIPWPLRVHYAASKGGMKLMTKTLALEYAPKGIRVNNIGPGAINTTGNAERWADPKQKADVESMIPMGYIGEPEEIAAVAAWLASKEASYVTGITLFADGGMTLSPSFQAGRG

SEQ ID NO: 113 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgcggtaaaagaagcggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtctgcaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaacgtccactatgccgcaagtaaaggcgggatgaagctgatgacaaaaacattagcgttggaatacgcgtcgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgggtccttcattccaggcaggccgcggt

SEQ ID NO: 114 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNAVKEAVIKAGGEAVVVQGDVTKEEDVKNIVQTAIKEFGTLDIMINNAGVCNPVPSHEMPLKDWDKVIGTNLTGAFLGSREAIKYFVENDIKGNVINMSSVIEVIPWPLNVHYAASKGGMKLMTKTLALEYASKGIRVNNIGPGAINTTGNAERWADPKQKADVESMIPMGYIGEPEEIAAVAAWLASKEASYVTGITLFADGGMTLGPSFQAGRG

SEQ ID NO: 115 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagacccgaacctggtaaaagaagcggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtctgcaatcctgtgccatctcacgaaatgccgctcaaggattgggataaagtcatcggtacgaacttaacgggtgcctttttaggaagccgtgaagcgattaaatatttcgtagaaaacgatatcaagggaaatgtcattaacatgtccagtgtgattgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgggtccttcattccaggcaggccgcggt

SEQ ID NO: 116 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNLVKEAVIKAGGEAVVVQGDVTKEEDVKNIVQTAIKEFGTLDIMINNAGVCNPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTGNAERWADPKQKADVESMIPMGYIGEPEEIAAVAAWLASKEASYVTGITLFADGGMTLGPSFQAGRG

SEQ ID NO: 117 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagacccgtggctggtaaaagaagcggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtctgcaatcctgtgccatctcacgaaatgccgctcaaggattgggataaagtcatcggtacgaacttaacgggtgcctttttaggaagccgtgaagcgattaaatatttcgtagaaaacgatatcaagggaaatgtcattaacatgtccagtgtgattgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgggtaatgctgagaagtgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgcgtccttcattccaggcaggccgcggt

SEQ ID NO: 118 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPWLVKEAVIKAGGEAVVVQGDVTKEEDVKNIVQTAIKEFGTLDIMINNAGVCNPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTGNAEKWADPKQKADVESMIPMGYIGEPEEIAAVAAWLASKEASYVTGITLFADGGMTLRPSFQAGRG

SEQ ID NO: 119 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagacccgaacagtgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtctgcaatcctgtgccatctcacgaaatgccgctcaaggattgggataaagtcatcggtacgaacttaacgggtgcctttttaggaagccgtgaagcgattaaatatttcgtagaaaacgatatcaagggaaatgtcattaacatgtccagtgtgatcgaagtgattccttggccgttaaacgtccactatgccgcaagtaaaggcgggatgaagctgatgacaaaaacattagcgttggaatacgcgccgaagggcattcgcgtcaataatattgggccaggtgcgatcaacacgacgaacaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 120 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNSVKEEVIKAGGEAVVVQGDVTKEEDVKNIVQTAIKEFGTLDIMINNAGVCNPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTNNAERWADPKQKADVESMIPMGYIGEPEEIAAVAAWLASKEASYVTGITLFADGGMTLYPSFQAGRG

SEQ ID NO: 121 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaaaacccgaacctggtaaaagaagcggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcagcaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgactgaagtgattccttggccgttaaacgtccactatgccgcaagtaaaggcgggatgaagctgatgacaaaaacattagcgttggaatacgcgccgaagggcattcgcgtcaataatattgggccaggtgcgatcaacacgacgatcaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 122 - protein, 261 aa, Artificial Sequence
  Variant of Glucose Dehydrogenase from Bacillus subtilis
MYPDLKGKVVAITGAATGLGKAMAIRFGKEQAKVVINYYSNKQNPNLVKEAVIKAGGEAVVVQGDVTKEEDVKNIVQTAIKEFGTLDIMINNAGVSNPVPSHEMPLKDWDKVIATNLTGAFLGSREAIKYFVENDIKGNVINMSSVTEVIPWPLNVHYAASKGGMKLMTKTLALEYAPKGIRVNNIGPGAINTTINAERWADPKQKADVESMIPMGYIGEPEEIAAVAAWLASKEASYVTGITLFADGGMTLYPSFQAGRG

SEQ ID NO: 123 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgcaaatcctgtgccatctcacgaaatgccgctcaaggattgggataaagtcatcggtacgaacttaacgggtgcctttttaggaagccgtgaagcgattaaatatttcgtagaaaacgatatcaagggaaatgtcattaacatgtccagtgtgatcgaagtgattccttggccgttaaacgtccactatgccgcaagtaaaggcgggatgaagctgatgacaaaaacattagcgttggaatacgcgccgaagggcattcgcgtcaataatattgggccaggtgcgatcaacacgacgaacaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 124 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNEVKEEVIKAGGEAVVVQGDVTKEEDVKNIVQTAIKEFGTLDIMINNAGVANPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTNNAERWADPKQKADVESMIPMGYIGEPEEIAAVAAWLASKEASYVTGITLFADGGMTLYPSFQAGRG

SEQ ID NO: 125 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagacccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtctgcaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgactgaagtgattccttggccgttacgcgtccactatgccgcaagtaaaggcgggatgaagctgatgacaaaaacattagcgttggaatacgcgccgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 126 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVCNPVPSHEMPLKDWDKVIATNLTGAFLGSREAIKYFVENDIKGNVINMSSVTEVIPWPLRVHYAASKGGMKLMTKTLALEYAPKGIRVNNIGPGAINTTGNAERWADPKQKADVESMIPMGYIGEPEEIAAVAAWLASKEASYVTGITLFADGGMTLYPSFQAGRG

SEQ ID NO: 127 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgcgtaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 128 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTRNAEKWADPKQKADVESMIPMGYIGEPEEIAAVAAWLASKEASYVTGITLFADGGMTLYPSFQAGRG

SEQ ID NO: 129 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagacccgtggctggtaaaagaagcggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcaccaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgactgaagtgattccttggccgttaaacgtccactatgccgcaagtaaaggcgggatgaagctgatgacaaaaacattagcgttggaatacgcgccgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 130 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPWLVKEAVIKAGGEAVVVQGDVTKEEDVKNIVQTAIKEFGTLDIMINNAGVTNPVPSHEMPLKDWDKVIGTNLTGAFLGSREAIKYFVENDIKGNVINMSSVTEVIPWPLNVHYAASKGGMKLMTKTLALEYAPKGIRVNNIGPGAINTTINAEKWADPKQKADVESMIPMGYIGEPEEIAAVAAWLASKEASYVTGITLFADGGMTLYPSFQAGRG

SEQ ID NO: 131 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcagcaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgactgaagtgattccttggccgttacaggtccactatgccgcaagtaaaggcgggatgaagctgatgacaaaaacattagcgttggaatacgcgtcgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 132 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNEVKEEVIKAGGEAVVVQGDVTKEEDVKNIVQTAIKEFGTLDIMINNAGVSNPVPSHEMPLKDWDKVIATNLTGAFLGSREAIKYFVENDIKGNVINMSSVTEVIPWPLQVHYAASKGGMKLMTKTLALEYASKGIRVNNIGPGAINTTGNAERWADPKQKADVESMIPMGYIGEPEEIAAVAAWLASKEASYVTGITLFADGGMTLYPSFQAGRG

SEQ ID NO: 133 - DNA, 783 bp, Artificial Sequence
  Variant of Glucose Dehydrogenase from Bacillus subtilis
atgtatccggatttaaaaggaaaagtcgtcgctattacaggagctgctagcgggctcggaaaggcgatggccattcgcttcggcaaggagcaggcaaaagtggttatcaactattatagtaataaacaagatccgaacgcggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcagcaatcctgtgccatctcacgaaatgccgctcaaggattgggataaagtcatcggtacgaacttaacgggtgcctttttaggaagccgtgaagcgattaaatatttcgtagaaaacgatatcaagggaaatgtcattaacatgtccagtgtgattgaagtgattccttggccgttaaacgtccactatgccgcaagtaaaggcgggatgaagctgatgacaaaaacattagcgttggaatacgcgccgaagggcattcgcgtcaataatattgggccaggtgcgatcaacacgacgaacaatgctgagaagtgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgagtccttcattccaggcaggccgcggt

SEQ ID NO: 134 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNAVKEEVIKAGGEAVVVQGDVTKEEDVKNIVQTAIKEFGTLDIMINNAGVSNPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTNNAEKWADPKQKADVESMIPMGYIGEPEEIAAVAAWLASKEASYVTGITLFADGGMTLSPSFQAGRG

SEQ ID NO: 135 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcaccaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaacgtccactatgccgcaagtaaaggcgggatgaagctgatgacaaaaacattagcgttggaatacgcgccgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 136 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNEVKEEVIKAGGEAVVVQGDVTKEEDVKNIVQTAIKEFGTLDIMINNAGVTNPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTGNAERWADPKQKADVESMIPMGYIGEPEEIAAVAAWLASKEASYVTGITLFADGGMTLYPSFQAGRG

SEQ ID NO: 137 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagacccgtgggcggtaaaagaagcggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgactgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 138 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPWAVKEAVIKAGGEAVVVQGDVTKEEDVKNIVQTAIKEFGTLDIMINNAGVENPVPSHEMPLKDWDKVIATNLTGAFLGSREAIKYFVENDIKGNVINMSSVTEVIPWPLNVHYAASKGGMKLMTKTLALEYAPKGIRVNNIGPGAINTTGNAERWADPKQKADVESMIPMGYIGEPEEIAAVAAWLASKEASYVTGITLFADGGMTLYPSFQAGRG

SEQ ID NO: 139 - DNA, 783 bp, Artificial Sequence
  Variant of Glucose Dehydrogenase from Bacillus subtilis
atgtatccggatttaaaaggaaaagtcgtcgctattacaggagctgctactgggctcggacgcgcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcagtaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgatcaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgctgccttcattccaggcaggccgcggt

SEQ ID NO: 140 - protein, 261 aa, Artificial Sequence
  Variant of Glucose Dehydrogenase from Bacillus subtilis
MYPDLKGKVVAITGAATGLGRAMAIRFGKEQAKVVINYYSNKQDPNEVKEEVIKAGGEAVVVQGDVTKEEDVKNIVQTAIKEFGTLDIMINNAGVSNPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTINAEKWADPKQKADVESMIPMGYIGEPEEIAAVAAWLASKEASYVTGITLFADGGMTLLPSFQAGRG

SEQ ID NO: 141 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacgaggtaaaagaagcggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcagcaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgattgaagtgattccttggccgttacaggtccactatgccgcaagtaaaggcgggatgaagctgatgacaaaaacattagcgttggaatacgcgccgaagggcattcgcgtcaataatattgggccaggtgcgatcaacacgacgatcaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 142 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNEVKEAVIKAGGEAVVVQGDVTKEEDVKNIVQTAIKEFGTLDIMINNAGVSNPVPSHEMPLKDWDKVIGTNLTGAFLGSREAIKYFVENDIKGNVINMSSVIEVIPWPLQVHYAASKGGMKLMTKTLALEYAPKGIRVNNIGPGAINTTINAERWADPKQKADVESMIPMGYIGEPEEIAAVAAWLASKEASYVTGITLFADGGMTLYPSFQAGRG

SEQ ID NO: 143 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagacccgaacgcggtaaaagaagcggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcaccaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgactgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgggtaatgctgagaagtgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 144 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNAVKEAVIKAGGEAVVVQGDVTKEEDVKNIVQTAIKEFGTLDIMINNAGVTNPVPSHEMPLKDWDKVIATNLTGAFLGSREAIKYFVENDIKGNVINMSSVTEVIPWPLNVHYAASKGGMKLMTKTLALEYAPKGIRVNNIGPGAINTTGNAEKWADPKQKADVESMIPMGYIGEPEEIAAVAAWLASKEASYVTGITLFADGGMTLYPSFQAGRG

SEQ ID NO: 145 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtctgcaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 146 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNEVKEEVIKAGGEAVVVQGDVTKEEDVKNIVQTAIKEFGTLDIMINNAGVCNPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTGNAERWADPKQKADVESMIPMGYIGEPEEIAAVAAWLASKEASYVTGITLFADGGMTLYPSFQAGRG

SEQ ID NO: 147 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagacccgaacagtgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtctgcaatcctgtgccatctcacgaaatgccgctcaaggattgggataaagtcatcggtacgaacttaacgggtgcctttttaggaagccgtgaagcgattaaatatttcgtagaaaacgatatcaagggaaatgtcattaacatgtccagtgtgactgaagtgattccttggccgttacaggtccactatgccgcaagtaaaggcgggatgaagctgatgacaaaaacattagcgttggaatacgcgccgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 148 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNSVKEEVIKAGGEAVVVQGDVTKEEDVKNIVQTAIKEFGTLDIMINNAGVCNPVPSHEMPLKDWDKVIGTNLTGAFLGSREAIKYFVENDIKGNVINMSSVTEVIPWPLQVHYAASKGGMKLMTKTLALEYAPKGIRVNNIGPGAINTTGNAERWADPKQKADVESMIPMGYIGEPEEIAAVAAWLASKEASYVTGITLFADGGMTLYPSFQAGRG

SEQ ID NO: 149 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcaataatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 150 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVNNPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTINAEKWADPKQKADVESMIPMGYIGEPEEIAAVAAWLASKEASYVTGITLFADGGMTLYPSFQAGRG

SEQ ID NO: 151 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagcggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcaccaatcctgtgccatctcacgaaatgccgctcaaggattgggataaagtcatcggtacgaacttaacgggtgcctttttaggaagccgtgaagcgattaaatatttcgtagaaaacgatatcaagggaaatgtcattaacatgtccagtgtgattgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgggtaatgctgagaagtgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgggtccttcattccaggcaggccgcggt

SEQ ID NO: 152 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEAVIKAGGEAVVVQGDVTKEEDVKNIVQTAIKEFGTLDIMINNAGVTNPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTGNAEKWADPKQKADVESMIPMGYIGEPEEIAAVAAWLASKEASYVTGITLFADGGMTLGPSFQAGRG

SEQ ID NO: 153 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagacccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgcaaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgatcgaagtgattccttggccgttacaggtccactatgccgcaagtaaaggcgggatgaagctgatgacaaaaacattagcgttggaatacgcgccgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgggtccttcattccaggcaggccgcggt

SEQ ID NO: 154 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNLVKEEVIKAGGEAVVVQGDVTKEEDVKNIVQTAIKEFGTLDIMINNAGVANPVPSHEMPLKDWDKVIATNLTGAFLGSREAIKYFVENDIKGNVINMSSVIEVIPWPLQVHYAASKGGMKLMTKTLALEYAPKGIRVNNIGPGAINTTINAEKWADPKQKADVESMIPMGYIGEPEEIAAVAAWLASKEASYVTGITLFADGGMTLGPSFQAGRG

SEQ ID NO: 155 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtctgcaatcctgtgccatctcacgaaatgccgctcaaggattgggataaagtcatcggtacgaacttaacgggtgcctttttaggaagccgtgaagcgattaaatatttcgtagaaaacgatatcaagggaaatgtcattaacatgtccagtgtgactgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 156 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVCNPVPSHEMPLKDWDKVIGTNLTGAFLGSREAIKYFVENDIKGNVINMSSVTEVIPWPLNVHYAASKGGMKLMTKTLALEYAPKGIRVNNIGPGAINTTGNAERWADPKQKADVESMIPMGYIGEPEEIAAVAAWLASKEASYVTGITLFADGGMTLYPSFQAGRG

SEQ ID NO: 157 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacgaggtaaaagaagcggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgattgaagtgattccttggccgttaaatgtccactatgccgcaagtaaaggcgggatgaagctgatgacaaaaacattagcgttggaatacgcgtcgaagggcattcgcgtcaataatattgggccaggtgcgatcaacacgacgggtaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgggtccttcattccaggcaggccgcggt

SEQ ID NO: 158 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNEVKEAVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLNVHYAASKGGMKLMTKTLALEYASKGIRVNNIGPGAINTTGNAEKWADPKQKADVESMIPMGYIGEPEEIAAVAAWLASKEASYVTGITLFADGGMTLGPSFQAGRG

SEQ ID NO: 159 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaaaacccgaacctggtaaaagaagcggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcaccaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 160 - protein, 261 aa, Artificial Sequence
  Variant of Glucose Dehydrogenase from Bacillus subtilis
MYPDLKGKVVAITGAATGLGKAMAIRFGKEQAKVVINYYSNKQNPNLVKEAVIKAGGEAVVVQGDVTKEEDVKNIVQTAIKEFGTLDIMINNAGVTNPVPSHEMPLKDWDKVIATNLTGAFLGSREAIKYFVENDIKGNVINMSSVIEVIPWPLNVHYAASKGGMKLMTKTLALEYAPKGIRVNNIGPGAINTTGNAERWADPKQKADVESMIPMGYIGEPEEIAAVAAWLASKEASYVTGITLFADGGMTLYPSFQAGRG

SEQ ID NO: 161 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacgaggtaaaagaagcggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgactgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 162 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNEVKEAVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVTEVIPWPLNVHYAASKGGMKLMTKTLALEYAPKGIRVNNIGPGAINTTINAEKWADPKQKADVESMIPMGYIGEPEEIAAVAAWLASKEASYVTGITLFADGGMTLYPSFQAGRG

SEQ ID NO: 163 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcaccaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgattgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgatcaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgagtccttcattccaggcaggccgcggt

SEQ ID NO: 164 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVTNPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTINAERWADPKQKADVESMIPMGYIGEPEEIAAVAAWLASKEASYVTGITLFADGGMTLSPSFQAGRG

SEQ ID NO: 165 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacgaggtaaaagaagcggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtctgcaatcctgtgccatctcacgaaatgccgctcaaggattgggataaagtcatcggtacgaacttaacgggtgcctttttaggaagccgtgaagcgattaaatatttcgtagaaaacgatatcaagggaaatgtcattaacatgtccagtgtgatcgaagtgattccttggccgttacaggtccactatgccgcaagtaaaggcgggatgaagctgatgacaaaaacattagcgttggaatacgcgccgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgggtccttcattccaggcaggccgcggt

SEQ ID NO: 166 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNEVKEAVIKAGGEAVVVQGDVTKEEDVKNIVQTAIKEFGTLDIMINNAGVCNPVPSHEMPLKDWDKVIGTNLTGAFLGSREAIKYFVENDIKGNVINMSSVIEVIPWPLQVHYAASKGGMKLMTKTLALEYAPKGIRVNNIGPGAINTTGNAERWADPKQKADVESMIPMGYIGEPEEIAAVAAWLASKEASYVTGITLFADGGMTLGPSFQAGRG

SEQ ID NO: 167 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagacccgtgggaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgactgaagtgattccttggccgttacaggtccactatgccgcaagtaaaggcgggatgaagctgatgacaaaaacattagcgttggaatacgcgtcgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 168 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPWEVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVTEVIPWPLQVHYAASKGGMKLMTKTLALEYASKGIRVNNIGPGAINTTGNAERWADPKQKADVESMIPMGYIGEPEEIAAVAAWLASKEASYVTGITLFADGGMTLYPSFQAGRG

SEQ ID NO: 169 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggtacgaacttaacgggtgcctttttaggaagccgtgaagcgattaaatatttcgtagaaaacgatatcaagggaaatgtcattaacatgtccagtgtgatcgaagtgattccttggccgttacgcgtccactatgccgcaagtaaaggcgggatgaagctgatgacaaaaacattagcgttggaatacgcgccgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgggtccttcattccaggcaggccgcggt

SEQ ID NO: 170 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLRVHYAASKGGMKLMTKTLALEYAPKGIRVNNIGPGAINTTGNAERWADPKQKADVESMIPMGYIGEPEEIAAVAAWLASKEASYVTGITLFADGGMTLGPSFQAGRG

SEQ ID NO: 171 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaaaacccgaacgaggtaaaagaagcggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgaacaatgctgagaagtgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgggtccttcattccaggcaggccgcggt

SEQ ID NO: 172 - protein, 261 aa, Artificial Sequence
  Variant of Glucose Dehydrogenase from Bacillus subtilis
MYPDLKGKVVAITGAATGLGKAMAIRFGKEQAKVVINYYSNKQNPNEVKEAVIKAGGEAVVVQGDVTKEEDVKNIVQTAIKEFGTLDIMINNAGVENPVPSHEMPLKDWDKVIATNLTGAFLGSREAIKYFVENDIKGNVINMSSVIEVIPWPLNVHYAASKGGMKLMTKTLALEYAPKGIRVNNIGPGAINTTNNAEKWADPKQKADVESMIPMGYIGEPEEIAAVAAWLASKEASYVTGITLFADGGMTLGPSFQAGRG

SEQ ID NO: 173 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcagcaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaacgtccactatgccgcaagtaaaggcgggatgaagctgatgacaaaaacattagcgttggaatacgcgccgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgagtccttcattccaggcaggccgcggt

SEQ ID NO: 174 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVSNPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTINAEKWADPKQKADVESMIPMGYIGEPEEIAAVAAWLASKEASYVTGITLFADGGMTLSPSFQAGRG

SEQ ID NO: 175 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagacccgaacctggtaaaagaagcggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcaccaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 176 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNLVKEAVIKAGGEAVVVQGDVTKEEDVKNIVQTAIKEFGTLDIMINNAGVTNPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTGNAERWADPKQKADVESMIPMGYIGEPEEIAAVAAWLASKEASYVTGITLFADGGMTLYPSFQAGRG

SEQ ID NO: 177 - DNA, 783 bp, Artificial Sequence
  Variant of Glucose Dehydrogenase from Bacillus subtilis
atgtatccggatttaaaaggaaaagtcgtcgctattacaggagctgctagcgggctcggaaaggcgatggccattcgcttcggcaaggagcaggcaaaagtggttatcaactattatagtaataaacaagacccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcaccaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaacgtccactatgccgcaagtaaaggcgggatgaagctgatgacaaaaacattagcgttggaatacgcgtcgaagggcattcgcgtcaataatattgggccaggtgcgatcaacacgacgattaatgctgagaagtgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgggtccttcattccaggcaggccgcggt

SEQ ID NO: 178 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNLVKEEVIKAGGEAVVVQGDVTKEEDVKNIVQTAIKEFGTLDIMINNAGVTNPVPSHEMPLKDWDKVIGTNLTGAFLGSREAIKYFVENDIKGNVINMSSVIEVIPWPLNVHYAASKGGMKLMTKTLALEYASKGIRVNNIGPGAINTTINAEKWADPKQKADVESMIPMGYIGEPEEIAAVAAWLASKEASYVTGITLFADGGMTLGPSFQAGRG

SEQ ID NO: 179 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaaaacccgaacagtgtaaaagaagcggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcggtacgaacttaacgggtgcctttttaggaagccgtgaagcgattaaatatttcgtagaaaacgatatcaagggaaatgtcattaacatgtccagtgtgattgaagtgattccttggccgttaaacgtccactatgccgcaagtaaaggcgggatgaagctgatgacaaaaacattagcgttggaatacgcgtcgaagggcattcgcgtcaataatattgggccaggtgcgatcaacacgacgaacaatgctgagaagtgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 180 - protein, 261 aa, Artificial Sequence
  Variant of Glucose Dehydrogenase from Bacillus subtilis
MYPDLKGKVVAITGAATGLGKAMAIRFGKEQAKVVINYYSNKQNPNSVKEAVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLNVHYAASKGGMKLMTKTLALEYASKGIRVNNIGPGAINTTNNAEKWADPKQKADVESMIPMGYIGEPEEIAAVAAWLASKEASYVTGITLFADGGMTLYPSFQAGRG

SEQ ID NO: 181 - DNA, 783 bp, Artificial Sequence
  Variant of Glucose Dehydrogenase from Bacillus subtilis
atgtatccggatttaaaaggaaaagtcgtcgctattacaggagctgctactgggctcggacgcgcgatggccattcgcttcggcaaggagcaggcaaaagtggttatcaactattatagtaataaacaagatccgaacgaggtaaaggaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgactgaagtgattccttggccgttacgcgtccactatgccgcaagtaaaggcgggatgaagctgatgacaaaaacattagcgttggaatacgcgccgaagggcattcgcgtcaataatattgggccaggtgcgatcaacacgacgatcaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgctgccttcattccaggcaggccgtggt

SEQ ID NO: 182 - protein, 261 aa, Artificial Sequence
  Variant of Glucose Dehydrogenase from Bacillus subtilis
MYPDLKGKVVAITGAATGLGRAMAIRFGKEQAKVVINYYSNKQDPNEVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVTEVIPWPLRVHYAASKGGMKLMTKTLALEYAPKGIRVNNIGPGAINTTINAEKWADPKQKADVESMIPMGYIGEPEEIAAVAAWLASKEASYVTGITLFADGGMTLLPSFQAGRG

SEQ ID NO: 183 - DNA, 783 bp, Artificial Sequence
  Variant of Glucose Dehydrogenase from Bacillus subtilis
atgtatccggatttaaaaggaaaagtcgtcgctattacaggagctgctactgggctcggaaaagcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcagtaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgctgccttcattccaggcaggccgcggt

SEQ ID NO: 184 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNEVKEEVIKAGGEAVVVQGDVTKEEDVKNIVQTAIKEFGTLDIMINNAGVSNPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTINAEKWADPKQKADVESMIPMGYIGEPEEIAAVAAWLASKEASYVTGITLFADGGMTLLPSFQAGRG

SEQ ID NO: 185 - DNA, 783 bp, Artificial Sequence
  Variant of Glucose Dehydrogenase from Bacillus subtilis
atgtatccggatttaaaaggaaaagtcgtcgctattacaggagctgctagcgggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcagcaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgattgaagtgattccttggccgttaaacgtccactatgccgcaagtaaaggcgggatgaagctgatgacaaaaacattagcgttggaatacgcgccgaagggcattcgcgtcaataatattgggccaggtgcgatcaacacgacgatcaatgctgagaagtgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgggtccttcattccaggcaggccgcggt

SEQ ID NO: 186 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVSNPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTINAEKWADPKQKADVESMIPMGYIGEPEEIAAVAAWLASKEASYVTGITLFADGGMTLGPSFQAGRG

SEQ ID NO: 187 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaaaacccgtgggaggtaaaagaagcggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcggtacgaacttaacgggtgcctttttaggaagccgtgaagcgattaaatatttcgtagaaaacgatatcaagggaaatgtcattaacatgtccagtgtgactgaagtgattccttggccgttacgcgtccactatgccgcaagtaaaggcgggatgaagctgatgacaaaaacattagcgttggaatacgcgtcgaagggcattcgcgtcaataatattgggccaggtgcgatcaacacgacgggtaatgctgagaagtgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgggtccttcattccaggcaggccgcggt

SEQ ID NO: 188 - protein, 261 aa, Artificial Sequence
  Variant of Glucose Dehydrogenase from Bacillus subtilis
MYPDLKGKVVAITGAASGLGKAMAIRFGKEQAKVVINYYSNKQNPWEVKEAVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVTEVIPWPLRVHYAASKGGMKLMTKTLALEYASKGIRVNNIGPGAINTTGNAEKWADPKQKADVESMIPMGYIGEPEEIAAVAAWLASKEASYVTGITLFADGGMTLGPSFQAGRG

SEQ ID NO: 189 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagacccgaacctggtaaaagaagcggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcagcaatcctgtgccatctcacgaaatgccgctcaaggattgggataaagtcatcggtacgaacttaacgggtgcctttttaggaagccgtgaagcgattaaatatttcgtagaaaacgatatcaagggaaatgtcattaacatgtccagtgtgactgaagtgattccttggccgttacaggtccactatgccgcaagtaaaggcgggatgaagctgatgacaaaaacattagcgttggaatacgcgccgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 190 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNLVKEAVIKAGGEAVVVQGDVTKEEDVKNIVQTAIKEFGTLDIMINNAGVSNPVPSHEMPLKDWDKVIGTNLTGAFLGSREAIKYFVENDIKGNVINMSSVTEVIPWPLQVHYAASKGGMKLMTKTLALEYAPKGIRVNNIGPGAINTTGNAERWADPKQKADVESMIPMGYIGEPEEIAAVAAWLASKEASYVTGITLFADGGMTLYPSFQAGRG

SEQ ID NO: 191 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggtacgaacttaacgggtgcctttttaggaagccgtgaagcgattaaatatttcgtagaaaacgatatcaagggaaatgtcattaacatgtccagtgtgattgaagtgattccttggccgttacgcgtccactatgccgcaagtaaaggcgggatgaagctgatgacaaaaacattagcgttggaatacgcgccgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgggtccttcattccaggcaggccgcggt

SEQ ID NO: 192 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNEVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLRVHYAASKGGMKLMTKTLALEYAPKGIRVNNIGPGAINTTINAEKWADPKQKADVESMIPMGYIGEPEEIAAVAAWLASKEASYVTGITLFADGGMTLGPSFQAGRG

SEQ ID NO: 193 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagacccgtggctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtctgcaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttacgcgtccactatgccgcaagtaaaggcgggatgaagctgatgacaaaaacattagcgttggaatacgcgtcgaagggcattcgcgtcaataatattgggccaggtgcgatcaacacgacgggtaatgctgagaagtgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgagtccttcattccaggcaggccgcggt

SEQ ID NO: 194 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPWLVKEEVIKAGGEAVVVQGDVTKEEDVKNIVQTAIKEFGTLDIMINNAGVCNPVPSHEMPLKDWDKVIGTNLTGAFLGSREAIKYFVENDIKGNVINMSSVIEVIPWPLRVHYAASKGGMKLMTKTLALEYASKGIRVNNIGPGAINTTGNAEKWADPKQKADVESMIPMGYIGEPEEIAAVAAWLASKEASYVTGITLFADGGMTLSPSFQAGRG

SEQ ID NO: 195 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagacccgaacagtgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcaccaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaacgtccactatgccgcaagtaaaggcgggatgaagctgatgacaaaaacattagcgttggaatacgcgccgaagggcattcgcgtcaataatattgggccaggtgcgattaacacgacgggtaatgctgagaagtgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgagtccttcattccaggcaggccgcggt

SEQ ID NO: 196 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNSVKEEVIKAGGEAVVVQGDVTKEEDVKNIVQTAIKEFGTLDIMINNAGVTNPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTGNAEKWADPKQKADVESMIPMGYIGEPEEIAAVAAWLASKEASYVTGITLFADGGMTLSPSFQAGRG

SEQ ID NO: 197 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcaccaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgactgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 198 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNEVKEEVIKAGGEAVVVQGDVTKEEDVKNIVQTAIKEFGTLDIMINNAGVTNPVPSHEMPLKDWDKVIGTNLTGAFLGSREAIKYFVENDIKGNVINMSSVTEVIPWPLNVHYAASKGGMKLMTKTLALEYAPKGIRVNNIGPGAINTTINAEKWADPKQKADVESMIPMGYIGEPEEIAAVAAWLASKEASYVTGITLFADGGMTLYPSFQAGRG

SEQ ID NO: 199 - DNA, 783 bp, Artificial Sequence
  Variant of Glucose Dehydrogenase from Bacillus subtilis
atgtatccggatttaaaaggaaaagtcgtcgctattacaggagctgctactgggctcggaaaagcgatggccattcgcttcggcaaggagcaggcaaaagtggttatcaactattatagtaataaacaagatccgaacgaggtagccgaactggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcagtaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgaacaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgctgccttcattccaggcaggccgcggt

SEQ ID NO: 200 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNEVAELVIKAGGEAVVVQGDVTKEEDVKNIVQTAIKEFGTLDIMINNAGVSNPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTNNAEKWADPKQKADVESMIPMGYIGEPEEIAAVAAWLASKEASYVTGITLFADGGMTLLPSFQAGRG

SEQ ID NO: 201 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagacccgaacgcggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcaccaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgtcgaagggcattcgcgtcaataatattgggccaggtgcgatcaacacgacgaacaatgctgagaagtgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgcgtccttcattccaggcaggccgcggt

SEQ ID NO: 202 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNAVKEEVIKAGGEAVVVQGDVTKEEDVKNIVQTAIKEFGTLDIMINNAGVTNPVPSHEMPLKDWDKVIGTNLTGAFLGSREAIKYFVENDIKGNVINMSSVIEVIPWPLNVHYAASKGGMKLMTKTLALEYASKGIRVNNIGPGAINTTNNAEKWADPKQKADVESMIPMGYIGEPEEIAAVAAWLASKEASYVTGITLFADGGMTLRPSFQAGRG

SEQ ID NO: 203 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgattgaagtgattccttggccgttaaatgtccactatgccgcaagtaaaggcgggatgaagctgatgacaaaaacattagcgttggaatacgcgtcgaagggcattcgcgtcaataatattgggccaggtgcgatcaacacgacgaacaatgctgagaagtgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgagtccttcattccaggcaggccgcggt

SEQ ID NO: 204 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNEVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLNVHYAASKGGMKLMTKTLALEYASKGIRVNNIGPGAINTTNNAEKWADPKQKADVESMIPMGYIGEPEEIAAVAAWLASKEASYVTGITLFADGGMTLSPSFQAGRG

SEQ ID NO: 205 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtctgcaatcctgtgccatctcacgaaatgccgctcaaggattgggataaagtcatcggtacgaacttaacgggtgcctttttaggaagccgtgaagcgattaaatatttcgtagaaaacgatatcaagggaaatgtcattaacatgtccagtgtgatcgaagtgattccttggccgttaaacgtccactatgccgcaagtaaaggcgggatgaagctgatgacaaaaacattagcgttggaatacgcgtcgaagggcattcgcgtcaataatattgggccaggtgcgatcaacacgacgggtaatgctgagaagtgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 206 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNEVKEEVIKAGGEAVVVQGDVTKEEDVKNIVQTAIKEFGTLDIMINNAGVCNPVPSHEMPLKDWDKVIGTNLTGAFLGSREAIKYFVENDIKGNVINMSSVIEVIPWPLNVHYAASKGGMKLMTKTLALEYASKGIRVNNIGPGAINTTGNAEKWADPKQKADVESMIPMGYIGEPEEIAAVAAWLASKEASYVTGITLFADGGMTLYPSFQAGRG

SEQ ID NO: 207 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcaccaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaacgtccactatgccgcaagtaaaggcgggatgaagctgatgacaaaaacattagcgttggaatacgcgccgaagggcattcgcgtcaataatattgggccaggtgcgatcaacacgacgatcaatgctgagaagtgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgcgtccttcattccaggcaggccgcggt

SEQ ID NO: 208 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNEVKEEVIKAGGEAVVVQGDVTKEEDVKNIVQTAIKEFGTLDIMINNAGVTNPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTINAEKWADPKQKADVESMIPMGYIGEPEEIAAVAAWLASKEASYVTGITLFADGGMTLRPSFQAGRG

SEQ ID NO: 209 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtctgcaatcctgtgccatctcacgaaatgccgctcaaggattgggataaagtcatcggtacgaacttaacgggtgcctttttaggaagccgtgaagcgattaaatatttcgtagaaaacgatatcaagggaaatgtcattaacatgtccagtgtgatcgaagtgattccttggccgttaaacgtccactatgccgcaagtaaaggcgggatgaagctgatgacaaaaacattagcgttggaatacgcgtcgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 210 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVCNPVPSHEMPLKDWDKVIGTNLTGAFLGSREAIKYFVENDIKGNVINMSSVIEVIPWPLNVHYAASKGGMKLMTKTLALEYASKGIRVNNIGPGAINTTGNAERWADPKQKADVESMIPMGYIGEPEEIAAVAAWLASKEASYVTGITLFADGGMTLYPSFQAGRG

SEQ ID NO: 211 - DNA, 783 bp, Artificial Sequence
  Variant of Glucose Dehydrogenase from Bacillus subtilis
atgtatccggatttaaaaggaaaagtcgtcgctattacaggagctgctagcgggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcaccaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgattgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgggtaatgctgagaagtgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgggtccttcattccaggcaggccgcggt

SEQ ID NO: 212 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVTNPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTGNAEKWADPKQKADVESMIPMGYIGEPEEIAAVAAWLASKEASYVTGITLFADGGMTLGPSFQAGRG

SEQ ID NO: 213 - DNA, 783 bp, Artificial Sequence
  Variant of Glucose Dehydrogenase from Bacillus subtilis
atgtatccggatttaaaaggaaaagtcgtcgctattacaggagctgctagcgggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcaccaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgattgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgaacaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 214 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVTNPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTNNAERWADPKQKADVESMIPMGYIGEPEEIAAVAAWLASKEASYVTGITLFADGGMTLYPSFQAGRG

SEQ ID NO: 215 - DNA, 783 bp, Artificial Sequence
  Variant of Glucose Dehydrogenase from Bacillus subtilis
atgtatccggatttaaaaggaaaagtcgtcgctattacaggagctgctactgggctcggaaaagcgatggccattcgcttcggcaaggagcaggcaaaagtggttatcaactattatagtaataaacaagatccgaacgaggtaaaggaactggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcagtaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttacgcgtccactatgccgcaagtaaaggcgggatgaagctgatgacaaaaacattagcgttggaatacgcgccgaagggcattcgcgtcaataatattgggccaggtgcgatcaacacgacgatcaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgctgccttcattccaggcaggccgtggt

SEQ ID NO: 216 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNEVKELVIKAGGEAVVVQGDVTKEEDVKNIVQTAIKEFGTLDIMINNAGVSNPVPSHEMPLKDWDKVIGTNLTGAFLGSREAIKYFVENDIKGNVINMSSVIEVIPWPLRVHYAASKGGMKLMTKTLALEYAPKGIRVNNIGPGAINTTINAEKWADPKQKADVESMIPMGYIGEPEEIAAVAAWLASKEASYVTGITLFADGGMTLLPSFQAGRG

SEQ ID NO: 217 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagcggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcagcaatcctgtgccatctcacgaaatgccgctcaaggattgggataaagtcatcggtacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgatcaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 218 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEAVIKAGGEAVVVQGDVTKEEDVKNIVQTAIKEFGTLDIMINNAGVSNPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTINAERWADPKQKADVESMIPMGYIGEPEEIAAVAAWLASKEASYVTGITLFADGGMTLYPSFQAGRG

SEQ ID NO: 219 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagacccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgcaaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgattgaagtgattccttggccgttaaacgtccactatgccgcaagtaaaggcgggatgaagctgatgacaaaaacattagcgttggaatacgcgccgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgagtccttcattccaggcaggccgcggt

SEQ ID NO: 220 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNLVKEEVIKAGGEAVVVQGDVTKEEDVKNIVQTAIKEFGTLDIMINNAGVANPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTGNAERWADPKQKADVESMIPMGYIGEPEEIAAVAAWLASKEASYVTGITLFADGGMTLSPSFQAGRG

SEQ ID NO: 221 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagcggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtctgcaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgatcgaagtgattccttggccgttacaggtccactatgccgcaagtaaaggcgggatgaagctgatgacaaaaacattagcgttggaatacgcgccgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgggtccttcattccaggcaggccgcggt

SEQ ID NO: 222 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEAVIKAGGEAVVVQGDVTKEEDVKNIVQTAIKEFGTLDIMINNAGVCNPVPSHEMPLKDWDKVIATNLTGAFLGSREAIKYFVENDIKGNVINMSSVIEVIPWPLQVHYAASKGGMKLMTKTLALEYAPKGIRVNNIGPGAINTTGNAERWADPKQKADVESMIPMGYIGEPEEIAAVAAWLASKEASYVTGITLFADGGMTLGPSFQAGRG

SEQ ID NO: 223 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaaaacccgaacagtgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcaccaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgaacaatgctgagaagtgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgggtccttcattccaggcaggccgcggt

SEQ ID NO: 224 - protein, 261 aa, Artificial Sequence
  Variant of Glucose Dehydrogenase from Bacillus subtilis
MYPDLKGKVVAITGAASGLGKAMAIRFGKEQAKVVINYYSNKQNPNSVKEEVIKAGGEAVVVQGDVTKEEDVKNIVQTAIKEFGTLDIMINNAGVTNPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTNNAEKWADPKQKADVESMIPMGYIGEPEEIAAVAAWLASKEASYVTGITLFADGGMTLGPSFQAGRG

SEQ ID NO: 225 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaaaacccgtgggcggtaaaagaagcggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttacgcgtccactatgccgcaagtaaaggcgggatgaagctgatgacaaaaacattagcgttggaatacgcgtcgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgggtccttcattccaggcaggccgcggt

SEQ ID NO: 226 - protein, 261 aa, Artificial Sequence
  Variant of Glucose Dehydrogenase from Bacillus subtilis
MYPDLKGKVVAITGAASGLGKAMAIRFGKEQAKVVINYYSNKQNPWAVKEAVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLRVHYAASKGGMKLMTKTLALEYASKGIRVNNIGPGAINTTINAEKWADPKQKADVESMIPMGYIGEPEEIAAVAAWLASKEASYVTGITLFADGGMTLGPSFQAGRG

SEQ ID NO: 227 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcagcaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgactgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgatcaatgctgagaagtgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 228 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVSNPVPSHEMPLKDWDKVIGTNLTGAFLGSREAIKYFVENDIKGNVINMSSVTEVIPWPLNVHYAASKGGMKLMTKTLALEYAPKGIRVNNIGPGAINTTINAEKWADPKQKADVESMIPMGYIGEPEEIAAVAAWLASKEASYVTGITLFADGGMTLYPSFQAGRG

SEQ ID NO: 229 - DNA, 783 bp, Artificial Sequence
  Variant of Glucose Dehydrogenase from Bacillus subtilis
atgtatccggatttaaaaggaaaagtcgtcgctattacaggagctgctagcgggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcagcaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgatcgaagtgattccttggccgttacaggtccactatgccgcaagtaaaggcgggatgaagctgatgacaaaaacattagcgttggaatacgcgccgaagggcattcgcgtcaataatattgggccaggtgcgatcaacacgacgaacaatgctgagaagtgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgagtccttcattccaggcaggccgcggt

SEQ ID NO: 230 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVSNPVPSHEMPLKDWDKVIATNLTGAFLGSREAIKYFVENDIKGNVINMSSVIEVIPWPLQVHYAASKGGMKLMTKTLALEYAPKGIRVNNIGPGAINTTNNAEKWADPKQKADVESMIPMGYIGEPEEIAAVAAWLASKEASYVTGITLFADGGMTLSPSFQAGRG

SEQ ID NO: 231 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcaccaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgggtccttcattccaggcaggccgcggt

SEQ ID NO: 232 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVTNPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTINAEKWADPKQKADVESMIPMGYIGEPEEIAAVAAWLASKEASYVTGITLFADGGMTLGPSFQAGRG

SEQ ID NO: 233 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagacccgtggctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcaccaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgatcgaagtgattccttggccgttaaacgtccactatgccgcaagtaaaggcgggatgaagctgatgacaaaaacattagcgttggaatacgcgccgaagggcattcgcgtcaataatattgggccaggtgcgatcaacacgacgaacaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 234 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPWLVKEEVIKAGGEAVVVQGDVTKEEDVKNIVQTAIKEFGTLDIMINNAGVTNPVPSHEMPLKDWDKVIATNLTGAFLGSREAIKYFVENDIKGNVINMSSVIEVIPWPLNVHYAASKGGMKLMTKTLALEYAPKGIRVNNIGPGAINTTNNAERWADPKQKADVESMIPMGYIGEPEEIAAVAAWLASKEASYVTGITLFADGGMTLYPSFQAGRG

SEQ ID NO: 235 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtctgcaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaacgtccactatgccgcaagtaaaggcgggatgaagctgatgacaaaaacattagcgttggaatacgcgccgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgagtccttcattccaggcaggccgcggt

SEQ ID NO: 236 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVCNPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTINAEKWADPKQKADVESMIPMGYIGEPEEIAAVAAWLASKEASYVTGITLFADGGMTLSPSFQAGRG

SEQ ID NO: 237 - DNA, 783 bp, Artificial Sequence
  Variant of Glucose Dehydrogenase from Bacillus subtilis
atgtatccggatttaaaaggaaaagtcgtcgctattacaggagctgctactgggctcggacgcgcgatggccattcgcttcggcaaggagcaggcaaaagtggttatcaactattatagtaataaacaagatccgaacgaggtagccgaactggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcagtaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 238 - protein, 261 aa, Artificial Sequence
  Variant of Glucose Dehydrogenase from Bacillus subtilis
MYPDLKGKVVAITGAATGLGRAMAIRFGKEQAKVVINYYSNKQDPNEVAELVIKAGGEAVVVQGDVTKEEDVKNIVQTAIKEFGTLDIMINNAGVSNPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTINAEKWADPKQKADVESMIPMGYIGEPEEIAAVAAWLASKEASYVTGITLFADGGMTLYPSFQAGRG

SEQ ID NO: 239 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcagcaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgtcgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 240 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNEVKEEVIKAGGEAVVVQGDVTKEEDVKNIVQTAIKEFGTLDIMINNAGVSNPVPSHEMPLKDWDKVIGTNLTGAFLGSREAIKYFVENDIKGNVINMSSVIEVIPWPLNVHYAASKGGMKLMTKTLALEYASKGIRVNNIGPGAINTTINAEKWADPKQKADVESMIPMGYIGEPEEIAAVAAWLASKEASYVTGITLFADGGMTLYPSFQAGRG

SEQ ID NO: 241 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacgaggtaaaagaagcggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtctgcaatcctgtgccatctcacgaaatgccgctcaaggattgggataaagtcatcggtacgaacttaacgggtgcctttttaggaagccgtgaagcgattaaatatttcgtagaaaacgatatcaagggaaatgtcattaacatgtccagtgtgattgaagtgattccttggccgttacgcgtccactatgccgcaagtaaaggcgggatgaagctgatgacaaaaacattagcgttggaatacgcgtcgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 242 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNEVKEAVIKAGGEAVVVQGDVTKEEDVKNIVQTAIKEFGTLDIMINNAGVCNPVPSHEMPLKDWDKVIGTNLTGAFLGSREAIKYFVENDIKGNVINMSSVIEVIPWPLRVHYAASKGGMKLMTKTLALEYASKGIRVNNIGPGAINTTINAEKWADPKQKADVESMIPMGYIGEPEEIAAVAAWLASKEASYVTGITLFADGGMTLYPSFQAGRG

SEQ ID NO: 243 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcaagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 244 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVKNPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTINAEKWADPKQKADVESMIPMGYIGEPEEIAAVAAWLASKEASYVTGITLFADGGMTLYPSFQAGRG

SEQ ID NO: 245 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagcggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcaccaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgatcaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 246 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEAVIKAGGEAVVVQGDVTKEEDVKNIVQTAIKEFGTLDIMINNAGVTNPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTINAERWADPKQKADVESMIPMGYIGEPEEIAAVAAWLASKEASYVTGITLFADGGMTLYPSFQAGRG

SEQ ID NO: 247 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgcaaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgactgaagtgattccttggccgttaaacgtccactatgccgcaagtaaaggcgggatgaagctgatgacaaaaacattagcgttggaatacgcgccgaagggcattcgcgtcaataatattgggccaggtgcgatcaacacgacgggtaatgctgagaagtgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 248 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVANPVPSHEMPLKDWDKVIGTNLTGAFLGSREAIKYFVENDIKGNVINMSSVTEVIPWPLNVHYAASKGGMKLMTKTLALEYAPKGIRVNNIGPGAINTTGNAEKWADPKQKADVESMIPMGYIGEPEEIAAVAAWLASKEASYVTGITLFADGGMTLYPSFQAGRG

SEQ ID NO: 249 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagacccgaacagtgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggtacgaacttaacgggtgcctttttaggaagccgtgaagcgattaaatatttcgtagaaaacgatatcaagggaaatgtcattaacatgtccagtgtgattgaagtgattccttggccgttacgcgtccactatgccgcaagtaaaggcgggatgaagctgatgacaaaaacattagcgttggaatacgcgccgaagggcattcgcgtcaataatattgggccaggtgcgatcaacacgacgattaatgctgagaagtgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgggtccttcattccaggcaggccgcggt

SEQ ID NO: 250 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNSVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLRVHYAASKGGMKLMTKTLALEYAPKGIRVNNIGPGAINTTINAEKWADPKQKADVESMIPMGYIGEPEEIAAVAAWLASKEASYVTGITLFADGGMTLGPSFQAGRG

SEQ ID NO: 251 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgacatcaagggaaatgtcattaacatgtccagtgtgactgaagtgattccttggccgttaaacgtccactatgccgcaagtaaaggcgggatgaagctgatgacaaaaacattagcgttggaatacgcgtcgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 252 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNEVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVTEVIPWPLNVHYAASKGGMKLMTKTLALEYASKGIRVNNIGPGAINTTINAEKWADPKQKADVESMIPMGYIGEPEEIAAVAAWLASKEASYVTGITLFADGGMTLYPSFQAGRG

SEQ ID NO: 253 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagacccgtgggcggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtctgcaatcctgtgccatctcacgaaatgccgctcaaggattgggataaagtcatcggtacgaacttaacgggtgcctttttaggaagccgtgaagcgattaaatatttcgtagaaaacgatatcaagggaaatgtcattaacatgtccagtgtgattgaagtgattccttggccgttaaacgtccactatgccgcaagtaaaggcgggatgaagctgatgacaaaaacattagcgttggaatacgcgccgaagggcattcgcgtcaataatattgggccaggtgcgatcaacacgacgggtaatgctgagaagtgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 254 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPWAVKEEVIKAGGEAVVVQGDVTKEEDVKNIVQTAIKEFGTLDIMINNAGVCNPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTGNAEKWADPKQKADVESMIPMGYIGEPEEIAAVAAWLASKEASYVTGITLFADGGMTLYPSFQAGRG

SEQ ID NO: 255 - DNA, 783 bp, Artificial Sequence
  Variant of Glucose Dehydrogenase from Bacillus subtilis
atgtatccggatttaaaaggaaaagtcgtcgctattacaggagctgctactgggctcggaaaagcgatggccattcgcttcggcaaggagcaggcaaaagtggttatcaactattatagtaatacgcaagatccgaacgaggtaaaggaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcagtaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgtggt

SEQ ID NO: 256 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNEVKEEVIKAGGEAVVVQGDVTKEEDVKNIVQTAIKEFGTLDIMINNAGVSNPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTINAEKWADPKQKADVESMIPMGYIGEPEEIAAVAAWLASKEASYVTGITLFADGGMTLYPSFQAGRG

SEQ ID NO: 257 - DNA, 783 bp, Artificial Sequence
  Variant of Glucose Dehydrogenase from Bacillus subtilis
atgtatccggatttaaaaggaaaagtcgtcgctattacaggagctgctactgggctcggacgcgcgatggccattcgcttcggcaaggagcaggcaaaagtggttatcaactattatagtaataaacaagatccgaacgaggtaaaggaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcagtaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 258 - protein, 261 aa, Artificial Sequence
  Variant of Glucose Dehydrogenase from Bacillus subtilis
MYPDLKGKVVAITGAATGLGRAMAIRFGKEQAKVVINYYSNKQDPNEVKEEVIKAGGEAVVVQGDVTKEEDVKNIVQTAIKEFGTLDIMINNAGVSNPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTINAEKWADPKQKADVESMIPMGYIGEPEEIAAVAAWLASKEASYVTGITLFADGGMTLYPSFQAGRG

SEQ ID NO: 259 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcaccaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgggtaatgctgagaagtgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgcgtccttcattccaggcaggccgcggt

SEQ ID NO: 260 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVTNPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTGNAEKWADPKQKADVESMIPMGYIGEPEEIAAVAAWLASKEASYVTGITLFADGGMTLRPSFQAGRG

SEQ ID NO: 261 - DNA, 783 bp, Artificial Sequence
  Variant of Glucose Dehydrogenase from Bacillus subtilis
atgtatccggatttaaaaggaaaagtcgtcgctattacaggagctgctagcgggctcggaaaggcgatggccattcgcttcggcaaggagcaggcaaaagtggttatcaactattatagtaataaacaaaacccgaacgcggtaaaagaagcggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcaccaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaacgtccactatgccgcaagtaaaggcgggatgaagctgatgacaaaaacattagcgttggaatacacgtcgaagggcattcgcgtcaataatattgggccaggtgcgatcaacacgacgatcaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgagtccttcattccaggcaggccgcggt

SEQ ID NO: 262 - protein, 261 aa, Artificial Sequence
  Variant of Glucose Dehydrogenase from Bacillus subtilis
MYPDLKGKVVAITGAASGLGKAMAIRFGKEQAKVVINYYSNKQNPNAVKEAVIKAGGEAVVVQGDVTKEEDVKNIVQTAIKEFGTLDIMINNAGVTNPVPSHEMPLKDWDKVIGTNLTGAFLGSREAIKYFVENDIKGNVINMSSVIEVIPWPLNVHYAASKGGMKLMTKTLALEYTSKGIRVNNIGPGAINTTINAERWADPKQKADVESMIPMGYIGEPEEIAAVAAWLASKEASYVTGITLFADGGMTLSPSFQAGRG

SEQ ID NO: 263 - DNA, 783 bp, Artificial Sequence
  Variant of Glucose Dehydrogenase from Bacillus subtilis
atgtatccggatttaaaaggaaaagtcgtcgctattacaggagctgctagcgggctcggaaaggcgatggccattcgcttcggcaaggagcaggcaaaagtggttatcaactattatagtaataaacaagatccgaacgcggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgactgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgggtaatgctgagaagtgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 264 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNAVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVTEVIPWPLNVHYAASKGGMKLMTKTLALEYAPKGIRVNNIGPGAINTTGNAEKWADPKQKADVESMIPMGYIGEPEEIAAVAAWLASKEASYVTGITLFADGGMTLYPSFQAGRG

SEQ ID NO: 265 - DNA, 783 bp, Artificial Sequence
  Variant of Glucose Dehydrogenase from Bacillus subtilis
atgtatccggatttaaaaggaaaagtcgtcgctattacaggagctgctactgggctcggaaaagcgatggccattcgcttcggcaaggagcaggcaaaagtggttatcaactattatagtaataaacaagatccgaacgaggtagccgaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcagtaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttacgcgtccactatgccgcaagtaaaggcgggatgaagctgatgacaaaaacattagcgttggaatacgcgccgaagggcattcgcgtcaataatattgggccaggtgcgatcaacacgacgatcaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgctgccttcattccaggcaggccgcggt

SEQ ID NO: 266 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNEVAEEVIKAGGEAVVVQGDVTKEEDVKNIVQTAIKEFGTLDIMINNAGVSNPVPSHEMPLKDWDKVIGTNLTGAFLGSREAIKYFVENDIKGNVINMSSVIEVIPWPLRVHYAASKGGMKLMTKTLALEYAPKGIRVNNIGPGAINTTINAEKWADPKQKADVESMIPMGYIGEPEEIAAVAAWLASKEASYVTGITLFADGGMTLLPSFQAGRG

SEQ ID NO: 267 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaaaacccgaacgcggtaaaagaagcggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgcaaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaacgtccactatgccgcaagtaaaggcgggatgaagctgatgacaaaaacattagcgttggaatacgcgccgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 268 - protein, 261 aa, Artificial Sequence
  Variant of Glucose Dehydrogenase from Bacillus subtilis
MYPDLKGKVVAITGAATGLGKAMAIRFGKEQAKVVINYYSNKQNPNAVKEAVIKAGGEAVVVQGDVTKEEDVKNIVQTAIKEFGTLDIMINNAGVANPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTINAEKWADPKQKADVESMIPMGYIGEPEEIAAVAAWLASKEASYVTGITLFADGGMTLYPSFQAGRG

SEQ ID NO: 269 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacgaggtaaaagaagcggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtctgcaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgaacaatgctgagaagtgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 270 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNEVKEAVIKAGGEAVVVQGDVTKEEDVKNIVQTAIKEFGTLDIMINNAGVCNPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTNNAEKWADPKQKADVESMIPMGYIGEPEEIAAVAAWLASKEASYVTGITLFADGGMTLYPSFQAGRG

SEQ ID NO: 271 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaaaacccgaacagtgtaaaagaagcggtcatcaaggcgggcggcgaagctgttgtcgtccaaggagatgtcacgaaagaggaagatgtaaaaaatatcgtgcaaacggcaattaaggagttcggcacactcgatattatgattaataatgccggtgtcaccaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgactgaagtgattccttggccgttaaacgtccactatgccgcaagtaaaggcgggatgaagctgatgacaaaaacattagcgttggaatacgcgccgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgggtccttcattccaggcaggccgcggt

SEQ ID NO: 272 - protein, 261 aa, Artificial Sequence
  Variant of Glucose Dehydrogenase from Bacillus subtilis
MYPDLKGKVVAITGAATGLGKAMAIRFGKEQAKVVINYYSNKQNPNSVKEAVIKAGGEAVVVQGDVTKEEDVKNIVQTAIKEFGTLDIMINNAGVTNPVPSHEMPLKDWDKVIGTNLTGAFLGSREAIKYFVENDIKGNVINMSSVTEVIPWPLNVHYAASKGGMKLMTKTLALEYAPKGIRVNNIGPGAINTTINAEKWADPKQKADVESMIPMGYIGEPEEIAAVAAWLASKEASYVTGITLFADGGMTLGPSFQAGRG

SEQ ID NO: 273 - DNA, 783 bp, Artificial Sequence
  Variant of Glucose Dehydrogenase from Bacillus subtilis
atgtatccggatttaaaaggaaaagtcgtcgctattacaggagctgctactgggctcggaaaagcgatggccattcgcttcggcaaggagcaggcaaaagtggttatcaactattatagtaataaacaagatccgaacgaggtagccgaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcagtaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgatcaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 274 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNEVAEEVIKAGGEAVVVQGDVTKEEDVKNIVQTAIKEFGTLDIMINNAGVSNPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTINAEKWADPKQKADVESMIPMGYIGEPEEIAAVAAWLASKEASYVTGITLFADGGMTLYPSFQAGRG

SEQ ID NO: 275 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcaccaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaacgtccactatgccgcaagtaaaggcgggatgaagctgatgacaaaaacattagcgttggaatacgcgccgaagggcattcgcgtcaataatattgggccaggtgcgatcaacacgacgatcaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 276 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVTNPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTINAERWADPKQKADVESMIPMGYIGEPEEIAAVAAWLASKEASYVTGITLFADGGMTLYPSFQAGRG

SEQ ID NO: 277 - DNA, 783 bp, Artificial Sequence
  Variant of Glucose Dehydrogenase from Bacillus subtilis
atgtatccggatttaaaaggaaaagtcgtcgctattacaggagctgctagcgggctcggaaaggcgatggccattcgcttcggcaaggagcaggcaaaagtggttatcaactattatagtaataaacaagatccgaacgcggtaaaagaagcggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggtacgaacttaacgggtgcctttttaggaagccgtgaagcgattaaatatttcgtagaaaacgatatcaagggaaatgtcattaacatgtccagtgtgatcgaagtgattccttggccgttacgcgtccactatgccgcaagtaaaggcgggatgaagctgatgacaaaaacattagcgttggaatacgcgccgaagggcattcgcgtcaataatattgggccaggtgcgatcaacacgacgggtaatgctgagaagtgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgggtccttcattccaggcaggccgcggt

SEQ ID NO: 278 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNAVKEAVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLRVHYAASKGGMKLMTKTLALEYAPKGIRVNNIGPGAINTTGNAEKWADPKQKADVESMIPMGYIGEPEEIAAVAAWLASKEASYVTGITLFADGGMTLGPSFQAGRG

SEQ ID NO: 279 - DNA, 783 bp, Artificial Sequence
  Variant of Glucose Dehydrogenase from Bacillus subtilis
atgtatccggatttaaaaggaaaagtcgtcgctattacaggagctgctagcgggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgcaaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgactgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgcgtccttcattccaggcaggccgcggt

SEQ ID NO: 280 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVANPVPSHEMPLKDWDKVIGTNLTGAFLGSREAIKYFVENDIKGNVINMSSVTEVIPWPLNVHYAASKGGMKLMTKTLALEYAPKGIRVNNIGPGAINTTINAEKWADPKQKADVESMIPMGYIGEPEEIAAVAAWLASKEASYVTGITLFADGGMTLRPSFQAGRG

SEQ ID NO: 281 - DNA, 783 bp, Artificial Sequence
  Variant of Glucose Dehydrogenase from Bacillus subtilis
atgtatccggatttaaaaggaaaagtcgtcgctattacaggagctgctactgggctcggacgcgcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgaacaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 282 - protein, 261 aa, Artificial Sequence
  Variant of Glucose Dehydrogenase from Bacillus subtilis
MYPDLKGKVVAITGAATGLGRAMAIRFGKEQAKVVINYYSNKQDPNEVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTNNAEKWADPKQKADVESMIPMGYIGEPEEIAAVAAWLASKEASYVTGITLFADGGMTLYPSFQAGRG

SEQ ID NO: 283 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagacccgtgggaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtctgcaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgattgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgatcaatgctgagaagtgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgggtccttcattccaggcaggccgcggt

SEQ ID NO: 284 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPWEVKEEVIKAGGEAVVVQGDVTKEEDVKNIVQTAIKEFGTLDIMINNAGVCNPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTINAEKWADPKQKADVESMIPMGYIGEPEEIAAVAAWLASKEASYVTGITLFADGGMTLGPSFQAGRG

SEQ ID NO: 285 - DNA, 783 bp, Artificial Sequence
  Variant of Glucose Dehydrogenase from Bacillus subtilis
atgtatccggatttaaaaggaaaagtcgtcgctattacaggagctgctactgggctcggaaaagcgatggccattcgcttcggcaaggagcaggcaaaagtggttatcaactattatagtaataagcaagatccgaacgaggtagccgaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcagtaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgaacaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 286 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNEVAEEVIKAGGEAVVVQGDVTKEEDVKNIVQTAIKEFGTLDIMINNAGVSNPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTNNAEKWADPKQKADVESMIPMGYIGEPEEIAAVAAWLASKEASYVTGITLFADGGMTLYPSFQAGRG

SEQ ID NO: 287 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacgaggtaaaagaagcggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcagcaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgattgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgatcaatgctgagaagtgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 288 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNEVKEAVIKAGGEAVVVQGDVTKEEDVKNIVQTAIKEFGTLDIMINNAGVSNPVPSHEMPLKDWDKVIATNLTGAFLGSREAIKYFVENDIKGNVINMSSVIEVIPWPLNVHYAASKGGMKLMTKTLALEYAPKGIRVNNIGPGAINTTINAEKWADPKQKADVESMIPMGYIGEPEEIAAVAAWLASKEASYVTGITLFADGGMTLYPSFQAGRG

SEQ ID NO: 289 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtctgcaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgattgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 290 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNEVKEEVIKAGGEAVVVQGDVTKEEDVKNIVQTAIKEFGTLDIMINNAGVCNPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTINAEKWADPKQKADVESMIPMGYIGEPEEIAAVAAWLASKEASYVTGITLFADGGMTLYPSFQAGRG

SEQ ID NO: 291 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagacccgtgggcggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggtacgaacttaacgggtgcctttttaggaagccgtgaagcgattaaatatttcgtagaaaacgatatcaagggaaatgtcattaacatgtccagtgtgatcgaagtgattccttggccgttaaacgtccactatgccgcaagtaaaggcgggatgaagctgatgacaaaaacattagcgttggaatacgcgtcgaagggcattcgcgtcaataatattgggccaggtgcgatcaacacgacgatcaatgctgagaagtgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 292 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPWAVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLNVHYAASKGGMKLMTKTLALEYASKGIRVNNIGPGAINTTINAEKWADPKQKADVESMIPMGYIGEPEEIAAVAAWLASKEASYVTGITLFADGGMTLYPSFQAGRG

SEQ ID NO: 293 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgattgaagtgattccttggccgttacaggtccactatgccgcaagtaaaggcgggatgaagctgatgacaaaaacattagcgttggaatacgcgccgaagggcattcgcgtcaataatattgggccaggtgcgatcaacacgacgggtaatgctgagaagtgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgagtccttcattccaggcaggccgcggt

SEQ ID NO: 294 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNEVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLQVHYAASKGGMKLMTKTLALEYAPKGIRVNNIGPGAINTTGNAEKWADPKQKADVESMIPMGYIGEPEEIAAVAAWLASKEASYVTGITLFADGGMTLSPSFQAGRG

SEQ ID NO: 295 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagacccgaacctggtaaaagaagcggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtctgcaatcctgtgccatctcacgaaatgccgctcaaggattgggataaagtcatcggtacgaacttaacgggtgcctttttaggaagccgtgaagcgattaaatatttcgtagaaaacgatatcaagggaaatgtcattaacatgtccagtgtgactgaagtgattccttggccgttaaacgtccactatgccgcaagtaaaggcgggatgaagctgatgacaaaaacattagcgttggaatacgcgccgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 296 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNLVKEAVIKAGGEAVVVQGDVTKEEDVKNIVQTAIKEFGTLDIMINNAGVCNPVPSHEMPLKDWDKVIGTNLTGAFLGSREAIKYFVENDIKGNVINMSSVTEVIPWPLNVHYAASKGGMKLMTKTLALEYAPKGIRVNNIGPGAINTTGNAERWADPKQKADVESMIPMGYIGEPEEIAAVAAWLASKEASYVTGITLFADGGMTLYPSFQAGRG

SEQ ID NO: 297 - DNA, 783 bp, Artificial Sequence
  Variant of Glucose Dehydrogenase from Bacillus subtilis
atgtatccggatttaaaaggaaaagtcgtcgctattacaggagctgctagcgggctcggaaaggcgatggccattcgcttcggcaaggagcaggcaaaagtggttatcaactattatagtaataaacaagatccgaacgaggtaaaagaagcggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcaccaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgattgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgcgtccttcattccaggcaggccgcggt

SEQ ID NO: 298 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEAVIKAGGEAVVVQGDVTKEEDVKNIVQTAIKEFGTLDIMINNAGVTNPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTINAEKWADPKQKADVESMIPMGYIGEPEEIAAVAAWLASKEASYVTGITLFADGGMTLRPSFQAGRG

SEQ ID NO: 299 - DNA, 783 bp, Artificial Sequence
  Variant of Glucose Dehydrogenase from Bacillus subtilis
atgtatccggatttaaaaggaaaagtcgtcgctattacaggagctgctactgggctcggaaaagcgatggccattcgcttcggcaaggagcaggcaaaagtggttatcaactattatagtaataaacaagatccgaacgaggtaaaggaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcagtaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgaacaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 300 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNEVKEEVIKAGGEAVVVQGDVTKEEDVKNIVQTAIKEFGTLDIMINNAGVSNPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTNNAEKWADPKQKADVESMIPMGYIGEPEEIAAVAAWLASKEASYVTGITLFADGGMTLYPSFQAGRG

SEQ ID NO: 301 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgtcgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 302 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNEVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLNVHYAASKGGMKLMTKTLALEYASKGIRVNNIGPGAINTTINAEKWADPKQKADVESMIPMGYIGEPEEIAAVAAWLASKEASYVTGITLFADGGMTLYPSFQAGRG

SEQ ID NO: 303 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgcaaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttacaggtccactatgccgcaagtaaaggcgggatgaagctgatgacaaaaacattagcgttggaatacgcgccgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 304 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNEVKEEVIKAGGEAVVVQGDVTKEEDVKNIVQTAIKEFGTLDIMINNAGVANPVPSHEMPLKDWDKVIGTNLTGAFLGSREAIKYFVENDIKGNVINMSSVIEVIPWPLQVHYAASKGGMKLMTKTLALEYAPKGIRVNNIGPGAINTTGNAERWADPKQKADVESMIPMGYIGEPEEIAAVAAWLASKEASYVTGITLFADGGMTLYPSFQAGRG

SEQ ID NO: 305 - DNA, 783 bp, Artificial Sequence
  Variant of Glucose Dehydrogenase from Bacillus subtilis
atgtatccggatttaaaaggaaaagtcgtcgctattacaggagctgctagcgggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgcaaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgactgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 306 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVANPVPSHEMPLKDWDKVIGTNLTGAFLGSREAIKYFVENDIKGNVINMSSVTEVIPWPLNVHYAASKGGMKLMTKTLALEYAPKGIRVNNIGPGAINTTINAEKWADPKQKADVESMIPMGYIGEPEEIAAVAAWLASKEASYVTGITLFADGGMTLYPSFQAGRG

SEQ ID NO: 307 - DNA, 783 bp, Artificial Sequence
  Variant of Glucose Dehydrogenase from Bacillus subtilis
atgtatccggatttaaaaggaaaagtcgtcgctattacaggagctgctactgggctcggacgcgcgatggccattcgcttcggcaaggagcaggcaaaagtggttatcaactattatagtaataaacaagatccgaacgaggtaaaggaactggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcagtaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgatcaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgtggt

SEQ ID NO: 308 - protein, 261 aa, Artificial Sequence
  Variant of Glucose Dehydrogenase from Bacillus subtilis
MYPDLKGKVVAITGAATGLGRAMAIRFGKEQAKVVINYYSNKQDPNEVKELVIKAGGEAVVVQGDVTKEEDVKNIVQTAIKEFGTLDIMINNAGVSNPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTINAEKWADPKQKADVESMIPMGYIGEPEEIAAVAAWLASKEASYVTGITLFADGGMTLYPSFQAGRG

SEQ ID NO: 309 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcaccaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgattgaagtgattccttggccgttaaacgtccactatgccgcaagtaaaggcgggatgaagctgatgacaaaaacattagcgttggaatacgcgccgaagggcattcgcgtcaataatattgggccaggtgcgatcaacacgacgatcaatgctgagaagtgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgcgtccttcattccaggcaggccgcggt

SEQ ID NO: 310 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNLVKEEVIKAGGEAVVVQGDVTKEEDVKNIVQTAIKEFGTLDIMINNAGVTNPVPSHEMPLKDWDKVIATNLTGAFLGSREAIKYFVENDIKGNVINMSSVIEVIPWPLNVHYAASKGGMKLMTKTLALEYAPKGIRVNNIGPGAINTTINAEKWADPKQKADVESMIPMGYIGEPEEIAAVAAWLASKEASYVTGITLFADGGMTLRPSFQAGRG

SEQ ID NO: 311 - DNA, 783 bp, Artificial Sequence
  Variant of Glucose Dehydrogenase from Bacillus subtilis
atgtatccggatttaaaaggaaaagtcgtcgctattacaggagctgctagcgggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgcaaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgattgaagtgattccttggccgttacgcgtccactatgccgcaagtaaaggcgggatgaagctgatgacaaaaacattagcgttggaatacgcgtcgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgggtccttcattccaggcaggccgcggt

SEQ ID NO: 312 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVANPVPSHEMPLKDWDKVIATNLTGAFLGSREAIKYFVENDIKGNVINMSSVIEVIPWPLRVHYAASKGGMKLMTKTLALEYASKGIRVNNIGPGAINTTGNAERWADPKQKADVESMIPMGYIGEPEEIAAVAAWLASKEASYVTGITLFADGGMTLGPSFQAGRG

SEQ ID NO: 313 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtctgcaatcctgtgccatctcacgaaatgccgctcaaggattgggataaagtcatcggtacgaacttaacgggtgcctttttaggaagccgtgaagcgattaaatatttcgtagaaaacgatatcaagggaaatgtcattaacatgtccagtgtgattgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 314 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVCNPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTGNAERWADPKQKADVESMIPMGYIGEPEEIAAVAAWLASKEASYVTGITLFADGGMTLYPSFQAGRG

SEQ ID NO: 315 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgcaaatcctgtgccatctcacgaaatgccgctcaaggattgggataaagtcatcggtacgaacttaacgggtgcctttttaggaagccgtgaagcgattaaatatttcgtagaaaacgatatcaagggaaatgtcattaacatgtccagtgtgattgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 316 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVANPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTGNAERWADPKQKADVESMIPMGYIGEPEEIAAVAAWLASKEASYVTGITLFADGGMTLYPSFQAGRG

SEQ ID NO: 317 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggtacgaacttaacgggtgcctttttaggaagccgtgaagcgattaaatatttcgtagaaaacgatatcaagggaaatgtcattaacatgtccagtgtgactgaagtgattccttggccgttacaggtccactatgccgcaagtaaaggcgggatgaagctgatgacaaaaacattagcgttggaatacgcgccgaagggcattcgcgtcaataatattgggccaggtgcgatcaacacgacgatcaatgctgagaagtgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgggtccttcattccaggcaggccgcggt

SEQ ID NO: 318 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNEVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVTEVIPWPLQVHYAASKGGMKLMTKTLALEYAPKGIRVNNIGPGAINTTINAEKWADPKQKADVESMIPMGYIGEPEEIAAVAAWLASKEASYVTGITLFADGGMTLGPSFQAGRG

SEQ ID NO: 319 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcaccaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 320 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNEVKEEVIKAGGEAVVVQGDVTKEEDVKNIVQTAIKEFGTLDIMINNAGVTNPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTINAEKWADPKQKADVESMIPMGYIGEPEEIAAVAAWLASKEASYVTGITLFADGGMTLYPSFQAGRG

SEQ ID NO: 321 - DNA, 783 bp, Artificial Sequence
  Variant of Glucose Dehydrogenase from Bacillus subtilis
atgtatccggatttaaaaggaaaagtcgtcgctattacaggagctgctagtgggctcggacgcgcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcagtaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgatcaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgctgccttcattccaggcaggccgtggt

SEQ ID NO: 322 - protein, 261 aa, Artificial Sequence
  Variant of Glucose Dehydrogenase from Bacillus subtilis
MYPDLKGKVVAITGAASGLGRAMAIRFGKEQAKVVINYYSNKQDPNEVKEEVIKAGGEAVVVQGDVTKEEDVKNIVQTAIKEFGTLDIMINNAGVSNPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTINAEKWADPKQKADVESMIPMGYIGEPEEIAAVAAWLASKEASYVTGITLFADGGMTLLPSFQAGRG

SEQ ID NO: 323 - DNA, 783 bp, Artificial Sequence
  Variant of Glucose Dehydrogenase from Bacillus subtilis
atgtatccggatttaaaaggaaaagtcgtcgctattacaggagctgcttcagggctcggacgcgcgatggccattcgcttcggcaaggagcaggcaaaagtggttatcaactattatagtaataaacaagatccgaacgaggtagccgaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcagtaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgatcaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgctgccttcattccaggcaggccgtggt

SEQ ID NO: 324 - protein, 261 aa, Artificial Sequence
  Variant of Glucose Dehydrogenase from Bacillus subtilis
MYPDLKGKVVAITGAASGLGRAMAIRFGKEQAKVVINYYSNKQDPNEVAEEVIKAGGEAVVVQGDVTKEEDVKNIVQTAIKEFGTLDIMINNAGVSNPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTINAEKWADPKQKADVESMIPMGYIGEPEEIAAVAAWLASKEASYVTGITLFADGGMTLLPSFQAGRG

SEQ ID NO: 325 - DNA, 783 bp, Artificial Sequence
  Variant of Glucose Dehydrogenase from Bacillus subtilis
atgtatccggatttaaaaggaaaagtcgtcgctattacaggagctgctagcgggctcggaaaggcgatggccattcgcttcggcaaggagcaggcaaaagtggttatcaactattatagtaataaacaagatccgaacgaggtaaaagaagcggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtctgcaatcctgtgccatctcacgaaatgccgctcaaggattgggataaagtcatcggtacgaacttaacgggtgcctttttaggaagccgtgaagcgattaaatatttcgtagaaaacgatatcaagggaaatgtcattaacatgtccagtgtgatcgaagtgattccttggccgttacgcgtccactatgccgcaagtaaaggcgggatgaagctgatgacaaaaacattagcgttggaatacgcgtcgaagggcattcgcgtcaataatattgggccaggtgcgatcaacacgacgggtaatgctgagaagtgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgcgtccttcattccaggcaggccgcggt

SEQ ID NO: 326 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEAVIKAGGEAVVVQGDVTKEEDVKNIVQTAIKEFGTLDIMINNAGVCNPVPSHEMPLKDWDKVIGTNLTGAFLGSREAIKYFVENDIKGNVINMSSVIEVIPWPLRVHYAASKGGMKLMTKTLALEYASKGIRVNNIGPGAINTTGNAEKWADPKQKADVESMIPMGYIGEPEEIAAVAAWLASKEASYVTGITLFADGGMTLRPSFQAGRG

SEQ ID NO: 327 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcggtacgaacttaacgggtgcctttttaggaagccgtgaagcgattaaatatttcgtagaaaacgatatcaagggaaatgtcattaacatgtccagtgtgattgaagtgattccttggccgttacaggtccactatgccgcaagtaaaggcgggatgaagctgatgacaaaaacattagcgttggaatacgcgtcgaagggcattcgcgtcaataatattgggccaggtgcgatcaacacgacgatcaatgctgagaagtgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 328 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNEVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLQVHYAASKGGMKLMTKTLALEYASKGIRVNNIGPGAINTTINAEKWADPKQKADVESMIPMGYIGEPEEIAAVAAWLASKEASYVTGITLFADGGMTLYPSFQAGRG

SEQ ID NO: 329 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgggaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 330 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVGNPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTINAEKWADPKQKADVESMIPMGYIGEPEEIAAVAAWLASKEASYVTGITLFADGGMTLYPSFQAGRG

SEQ ID NO: 331 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacgcggtaaaagaagcggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcaccaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgattgaagtgattccttggccgttacgcgtccactatgccgcaagtaaaggcgggatgaagctgatgacaaaaacattagcgttggaatacgcgtcgaagggcattcgcgtcaataatattgggccaggtgcgatcaacacgacgatcaatgctgagaagtgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgcgtccttcattccaggcaggccgcggt

SEQ ID NO: 332 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNAVKEAVIKAGGEAVVVQGDVTKEEDVKNIVQTAIKEFGTLDIMINNAGVTNPVPSHEMPLKDWDKVIATNLTGAFLGSREAIKYFVENDIKGNVINMSSVIEVIPWPLRVHYAASKGGMKLMTKTLALEYASKGIRVNNIGPGAINTTINAEKWADPKQKADVESMIPMGYIGEPEEIAAVAAWLASKEASYVTGITLFADGGMTLRPSFQAGRG

SEQ ID NO: 333 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacgcggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgactgaagtgattccttggccgttaaacgtccactatgccgcaagtaaaggcgggatgaagctgatgacaaaaacattagcgttggaatacgcgccgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgagtccttcattccaggcaggccgcggt

SEQ ID NO: 334 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNAVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVTEVIPWPLNVHYAASKGGMKLMTKTLALEYAPKGIRVNNIGPGAINTTGNAERWADPKQKADVESMIPMGYIGEPEEIAAVAAWLASKEASYVTGITLFADGGMTLSPSFQAGRG

SEQ ID NO: 335 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgactgaagtgattccttggccgttacgcgtccactatgccgcaagtaaaggcgggatgaagctgatgacaaaaacattagcgttggaatacgcgccgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 336 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVTEVIPWPLRVHYAASKGGMKLMTKTLALEYAPKGIRVNNIGPGAINTTINAEKWADPKQKADVESMIPMGYIGEPEEIAAVAAWLASKEASYVTGITLFADGGMTLYPSFQAGRG

SEQ ID NO: 337 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacgaggtaaaagaagcggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcaccaatcctgtgccatctcacgaaatgccgctcaaggattgggataaagtcatcggtacgaacttaacgggtgcctttttaggaagccgtgaagcgattaaatatttcgtagaaaacgatatcaagggaaatgtcattaacatgtccagtgtgatcgaagtgattccttggccgttacgcgtccactatgccgcaagtaaaggcgggatgaagctgatgacaaaaacattagcgttggaatacgcgccgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgagtccttcattccaggcaggccgcggt

SEQ ID NO: 338 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNEVKEAVIKAGGEAVVVQGDVTKEEDVKNIVQTAIKEFGTLDIMINNAGVTNPVPSHEMPLKDWDKVIGTNLTGAFLGSREAIKYFVENDIKGNVINMSSVIEVIPWPLRVHYAASKGGMKLMTKTLALEYAPKGIRVNNIGPGAINTTGNAERWADPKQKADVESMIPMGYIGEPEEIAAVAAWLASKEASYVTGITLFADGGMTLSPSFQAGRG

SEQ ID NO: 339 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaggaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcagtaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgaacaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgctgccttcattccaggcaggccgcggt

SEQ ID NO: 340 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVSNPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTNNAEKWADPKQKADVESMIPMGYIGEPEEIAAVAAWLASKEASYVTGITLFADGGMTLLPSFQAGRG

SEQ ID NO: 341 - DNA, 783 bp, Artificial Sequence
  Variant of Glucose Dehydrogenase from Bacillus subtilis
atgtatccggatttaaaaggaaaagtcgtcgctattacaggagctgctagtgggctcggaaaagcgatggccattcgcttcggcaaggagcaggcaaaagtggttatcaactattatagtaataaacaagatccgaacgaggtagccgaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcagtaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgatcaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgctgccttcattccaggcaggccgcggt

SEQ ID NO: 342 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVAEEVIKAGGEAVVVQGDVTKEEDVKNIVQTAIKEFGTLDIMINNAGVSNPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTINAEKWADPKQKADVESMIPMGYIGEPEEIAAVAAWLASKEASYVTGITLFADGGMTLLPSFQAGRG

SEQ ID NO: 343 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgattaatgctgagaagtgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 344 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNLVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVIEVIPWPLNVHYAASKGGMKLMTKTLALEYAPKGIRVNNIGPGAINTTINAEKWADPKQKADVESMIPMGYIGEPEEIAAVAAWLASKEASYVTGITLFADGGMTLYPSFQAGRG

SEQ ID NO: 345 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtagccgaactggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcagtaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgatcaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 346 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVAELVIKAGGEAVVVQGDVTKEEDVKNIVQTAIKEFGTLDIMINNAGVSNPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTINAEKWADPKQKADVESMIPMGYIGEPEEIAAVAAWLASKEASYVTGITLFADGGMTLYPSFQAGRG

SEQ ID NO: 347 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacgaggtaaaagaagcggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcaccaatcctgtgccatctcacgaaatgccgctcaaggattgggataaagtcatcggtacgaacttaacgggtgcctttttaggaagccgtgaagcgattaaatatttcgtagaaaacgatatcaagggaaatgtcattaacatgtccagtgtgattgaagtgattccttggccgttaaacgtccactatgccgcaagtaaaggcgggatgaagctgatgacaaaaacattagcgttggaatacgcgtcgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 348 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNEVKEAVIKAGGEAVVVQGDVTKEEDVKNIVQTAIKEFGTLDIMINNAGVTNPVPSHEMPLKDWDKVIGTNLTGAFLGSREAIKYFVENDIKGNVINMSSVIEVIPWPLNVHYAASKGGMKLMTKTLALEYASKGIRVNNIGPGAINTTGNAERWADPKQKADVESMIPMGYIGEPEEIAAVAAWLASKEASYVTGITLFADGGMTLYPSFQAGRG

SEQ ID NO: 349 - DNA, 783 bp, Artificial Sequence
  Variant of Glucose Dehydrogenase from Bacillus subtilis
atgtatccggatttaaaaggaaaagtcgtcgctattacaggagctgctagcgggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttacaggtccactatgccgcaagtaaaggcgggatgaagctgatgacaaaaacattagcgttggaatacgcgtcgaagggcattcgcgtcaataatattgggccaggtgcgatcaacacgacgaacaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 350 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLQVHYAASKGGMKLMTKTLALEYASKGIRVNNIGPGAINTTNNAERWADPKQKADVESMIPMGYIGEPEEIAAVAAWLASKEASYVTGITLFADGGMTLYPSFQAGRG

SEQ ID NO: 351 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtagccgaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcagtaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgatcaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgtggt

SEQ ID NO: 352 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVAEEVIKAGGEAVVVQGDVTKEEDVKNIVQTAIKEFGTLDIMINNAGVSNPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTINAEKWADPKQKADVESMIPMGYIGEPEEIAAVAAWLASKEASYVTGITLFADGGMTLYPSFQAGRG

SEQ ID NO: 353 - DNA, 783 bp, Artificial Sequence
  Variant of Glucose Dehydrogenase from Bacillus subtilis
atgtatccggatttaaaaggaaaagtcgtcgctattacaggagctgctagcgggctcggaaaggcgatggccattcgcttcggcaaggagcaggcaaaagtggttatcaactattatagtaataaacaagacccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgatcgaagtgattccttggccgttaaacgtccactatgccgcaagtaaaggcgggatgaagctgatgacaaaaacattagcgttggaatacgcgtcgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 354 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNLVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVIEVIPWPLNVHYAASKGGMKLMTKTLALEYASKGIRVNNIGPGAINTTINAEKWADPKQKADVESMIPMGYIGEPEEIAAVAAWLASKEASYVTGITLFADGGMTLYPSFQAGRG

SEQ ID NO: 355 - DNA, 783 bp, Artificial Sequence
  Variant of Glucose Dehydrogenase from Bacillus subtilis
atgtatccggatttaaaaggaaaagtcgtcgctattacaggagctgctactgggctcggacgcgcgatggccattcgcttcggcaaggagcaggcaaaagtggttatcaactattatagtaataaacaagatccgaacgaggtaaaggaactggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgaacaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 356 - protein, 261 aa, Artificial Sequence
  Variant of Glucose Dehydrogenase from Bacillus subtilis
MYPDLKGKVVAITGAATGLGRAMAIRFGKEQAKVVINYYSNKQDPNEVKELVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTNNAEKWADPKQKADVESMIPMGYIGEPEEIAAVAAWLASKEASYVTGITLFADGGMTLYPSFQAGRG

SEQ ID NO: 357 - DNA, 783 bp, Artificial Sequence
  Variant of Glucose Dehydrogenase from Bacillus subtilis
atgtatccggatttaaaaggaaaagtcgtcgctattacaggagctgctagcgggctcggaaaggcgatggccattcgcttcggcaaggagcaggcaaaagtggttatcaactattatagtaataaacaaaacccgtggctggtaaaagaagcggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgtcgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgggtccttcattccaggcaggccgcggt

SEQ ID NO: 358 - protein, 261 aa, Artificial Sequence
  Variant of Glucose Dehydrogenase from Bacillus subtilis
MYPDLKGKVVAITGAASGLGKAMAIRFGKEQAKVVINYYSNKQNPWLVKEAVIKAGGEAVVVQGDVTKEEDVKNIVQTAIKEFGTLDIMINNAGVENPVPSHEMPLKDWDKVIATNLTGAFLGSREAIKYFVENDIKGNVINMSSVIEVIPWPLNVHYAASKGGMKLMTKTLALEYASKGIRVNNIGPGAINTTINAEKWADPKQKADVESMIPMGYIGEPEEIAAVAAWLASKEASYVTGITLFADGGMTLGPSFQAGRG

SEQ ID NO: 359 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagacccgaacctggtaaaagaagcggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcaccaatcctgtgccatctcacgaaatgccgctcaaggattgggataaagtcatcggtacgaacttaacgggtgcctttttaggaagccgtgaagcgattaaatatttcgtagaaaacgatatcaagggaaatgtcattaacatgtccagtgtgattgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgggtaatgctgagaagtgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 360 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNLVKEAVIKAGGEAVVVQGDVTKEEDVKNIVQTAIKEFGTLDIMINNAGVTNPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTGNAEKWADPKQKADVESMIPMGYIGEPEEIAAVAAWLASKEASYVTGITLFADGGMTLYPSFQAGRG

SEQ ID NO: 361 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcagcaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttacgcgtccactatgccgcaagtaaaggcgggatgaagctgatgacaaaaacattagcgttggaatacgcgtcgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 362 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNEVKEEVIKAGGEAVVVQGDVTKEEDVKNIVQTAIKEFGTLDIMINNAGVSNPVPSHEMPLKDWDKVIGTNLTGAFLGSREAIKYFVENDIKGNVINMSSVIEVIPWPLRVHYAASKGGMKLMTKTLALEYASKGIRVNNIGPGAINTTINAEKWADPKQKADVESMIPMGYIGEPEEIAAVAAWLASKEASYVTGITLFADGGMTLYPSFQAGRG

SEQ ID NO: 363 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacgaggtaaaagaagcggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgattgaagtgattccttggccgttaaacgtccactatgccgcaagtaaaggcgggatgaagctgatgacaaaaacattagcgttggaatacgcgccgaagggcattcgcgtcaataatattgggccaggtgcgatcaacacgacgatcaatgctgagaagtgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 364 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNEVKEAVIKAGGEAVVVQGDVTKEEDVKNIVQTAIKEFGTLDIMINNAGVENPVPSHEMPLKDWDKVIATNLTGAFLGSREAIKYFVENDIKGNVINMSSVIEVIPWPLNVHYAASKGGMKLMTKTLALEYAPKGIRVNNIGPGAINTTINAEKWADPKQKADVESMIPMGYIGEPEEIAAVAAWLASKEASYVTGITLFADGGMTLYPSFQAGRG

SEQ ID NO: 365 - DNA, 783 bp, Artificial Sequence
  Variant of Glucose Dehydrogenase from Bacillus subtilis
atgtatccggatttaaaaggaaaagtcgtcgctattacaggagctgctactgggctcggacgcgcgatggccattcgcttcggcaaggagcaggcaaaagtggttatcaactattatagtaataaacaagatccgaacgaggtaaaggaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttacgcgtccactatgccgcaagtaaaggcgggatgaagctgatgacaaaaacattagcgttggaatacgcgccgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgctgccttcattccaggcaggccgcggt

SEQ ID NO: 366 - protein, 261 aa, Artificial Sequence
  Variant of Glucose Dehydrogenase from Bacillus subtilis
MYPDLKGKVVAITGAATGLGRAMAIRFGKEQAKVVINYYSNKQDPNEVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLRVHYAASKGGMKLMTKTLALEYAPKGIRVNNIGPGAINTTINAEKWADPKQKADVESMIPMGYIGEPEEIAAVAAWLASKEASYVTGITLFADGGMTLLPSFQAGRG

SEQ ID NO: 367 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagacccgtggctggtaaaagaagcggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttacgcgtccactatgccgcaagtaaaggcgggatgaagctgatgacaaaaacattagcgttggaatacgcgccgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 368 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPWLVKEAVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLRVHYAASKGGMKLMTKTLALEYAPKGIRVNNIGPGAINTTGNAERWADPKQKADVESMIPMGYIGEPEEIAAVAAWLASKEASYVTGITLFADGGMTLYPSFQAGRG

SEQ ID NO: 369 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagacccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 370 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNEVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVIEVIPWPLNVHYAASKGGMKLMTKTLALEYAPKGIRVNNIGPGAINTTINAEKWADPKQKADVESMIPMGYIGEPEEIAAVAAWLASKEASYVTGITLFADGGMTLYPSFQAGRG

SEQ ID NO: 371 - DNA, 783 bp, Artificial Sequence
  Variant of Glucose Dehydrogenase from Bacillus subtilis
atgtatccggatttaaaaggaaaagtcgtcgctattacaggagctgctagcgggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttacgcgtccactatgccgcaagtaaaggcgggatgaagctgatgacaaaaacattagcgttggaatacgcgccgaagggcattcgcgtcaataatattgggccaggtgcgatcaacacgacgaacaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgcgtccttcattccaggcaggccgcggt

SEQ ID NO: 372 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLRVHYAASKGGMKLMTKTLALEYAPKGIRVNNIGPGAINTTNNAERWADPKQKADVESMIPMGYIGEPEEIAAVAAWLASKEASYVTGITLFADGGMTLRPSFQAGRG

SEQ ID NO: 373 - DNA, 783 bp, Artificial Sequence
  Variant of Glucose Dehydrogenase from Bacillus subtilis
atgtatccggatttaaaaggaaaagtcgtcgctattacaggagctgctagcgggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcaccaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgattgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgatcaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 374 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVTNPVPSHEMPLKDWDKVIATNLTGAFLGSREAIKYFVENDIKGNVINMSSVIEVIPWPLNVHYAASKGGMKLMTKTLALEYAPKGIRVNNIGPGAINTTINAERWADPKQKADVESMIPMGYIGEPEEIAAVAAWLASKEASYVTGITLFADGGMTLYPSFQAGRG

SEQ ID NO: 375 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagagattccttggccgttaaatgtccactatgccgcaagtaaaggcgggatgaagctgatgacaaaaacattagcgttggaatacgcgccgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 376 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEEIPWPLNVHYAASKGGMKLMTKTLALEYAPKGIRVNNIGPGAINTTINAEKWADPKQKADVESMIPMGYIGEPEEIAAVAAWLASKEASYVTGITLFADGGMTLYPSFQAGRG

SEQ ID NO: 377 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttacaggtccactatgccgcaagtaaaggcgggatgaagctgatgacaaaaacattagcgttggaatacgcgtcgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 378 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLQVHYAASKGGMKLMTKTLALEYASKGIRVNNIGPGAINTTGNAERWADPKQKADVESMIPMGYIGEPEEIAAVAAWLASKEASYVTGITLFADGGMTLYPSFQAGRG

SEQ ID NO: 379 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagcagatgacaaaaacattagcgttggaatacgcgccgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 380 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLNVHYAASKGGMKQMTKTLALEYAPKGIRVNNIGPGAINTTINAEKWADPKQKADVESMIPMGYIGEPEEIAAVAAWLASKEASYVTGITLFADGGMTLYPSFQAGRG

SEQ ID NO: 381 - DNA, 783 bp, Artificial Sequence
  Variant of Glucose Dehydrogenase from Bacillus subtilis
atgtatccggatttaaaaggaaaagtcgtcgctattacaggagctgctagtgggctcggacgcgcgatggccattcgcttcggcaaggagcaggcaaaagtggttatcaactattatagtaataaacaagatccgaacgaggtagccgaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcagtaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgaacaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 382 - protein, 261 aa, Artificial Sequence
  Variant of Glucose Dehydrogenase from Bacillus subtilis
MYPDLKGKVVAITGAASGLGRAMAIRFGKEQAKVVINYYSNKQDPNEVAEEVIKAGGEAVVVQGDVTKEEDVKNIVQTAIKEFGTLDIMINNAGVSNPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTNNAEKWADPKQKADVESMIPMGYIGEPEEIAAVAAWLASKEASYVTGITLFADGGMTLYPSFQAGRG

SEQ ID NO: 383 - DNA, 783 bp, Artificial Sequence
  Variant of Glucose Dehydrogenase from Bacillus subtilis
atgtatccggatttaaaaggaaaagtcgtcgctattacaggagctgctactgggctcggacgcgcgatggccattcgcttcggcaaggagcaggcaaaagtggttatcaactattatagtaatacgcaagatccgaacgaggtaaaggaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 384 - protein, 261 aa, Artificial Sequence
  Variant of Glucose Dehydrogenase from Bacillus subtilis
MYPDLKGKVVAITGAATGLGRAMAIRFGKEQAKVVINYYSNTQDPNEVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTINAEKWADPKQKADVESMIPMGYIGEPEEIAAVAAWLASKEASYVTGITLFADGGMTLYPSFQAGRG

SEQ ID NO: 385 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgattgaagtgattccttggccgttaaacgtccactatgccgcaagtaaaggcgggatgaagctgatgacaaaaacattagcgttggaatacgcgccgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgggtccttcattccaggcaggccgcggt

SEQ ID NO: 386 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVIEVIPWPLNVHYAASKGGMKLMTKTLALEYAPKGIRVNNIGPGAINTTGNAERWADPKQKADVESMIPMGYIGEPEEIAAVAAWLASKEASYVTGITLFADGGMTLGPSFQAGRG

SEQ ID NO: 387 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaacgtccactatgccgcaagtaaaggcgggatgaagctgatgacaaaaacattagcgttggaatacgcgtcgaagggcattcgcgtcaataatattgggccaggtgcgatcaacacgacgaacaatgctgagaagtgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 388 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLNVHYAASKGGMKLMTKTLALEYASKGIRVNNIGPGAINTTNNAEKWADPKQKADVESMIPMGYIGEPEEIAAVAAWLASKEASYVTGITLFADGGMTLYPSFQAGRG

SEQ ID NO: 389 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtctgcaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgactgaagtgattccttggccgttacaggtccactatgccgcaagtaaaggcgggatgaagctgatgacaaaaacattagcgttggaatacgcgccgaagggcattcgcgtcaataatattgggccaggtgcgatcaacacgacgatcaatgctgagaagtgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 390 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNEVKEEVIKAGGEAVVVQGDVTKEEDVKNIVQTAIKEFGTLDIMINNAGVCNPVPSHEMPLKDWDKVIATNLTGAFLGSREAIKYFVENDIKGNVINMSSVTEVIPWPLQVHYAASKGGMKLMTKTLALEYAPKGIRVNNIGPGAINTTINAEKWADPKQKADVESMIPMGYIGEPEEIAAVAAWLASKEASYVTGITLFADGGMTLYPSFQAGRG

SEQ ID NO: 391 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagacccgaacagtgtaaaagaagcggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtctgcaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgggtaatgctgagaagtgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 392 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNSVKEAVIKAGGEAVVVQGDVTKEEDVKNIVQTAIKEFGTLDIMINNAGVCNPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTGNAEKWADPKQKADVESMIPMGYIGEPEEIAAVAAWLASKEASYVTGITLFADGGMTLYPSFQAGRG

SEQ ID NO: 393 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtcaattatgccgcaagtaaaggcgggatgaagctgatgacaaaaacattagcgttggaatacgcgccgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 394 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLNVNYAASKGGMKLMTKTLALEYAPKGIRVNNIGPGAINTTINAEKWADPKQKADVESMIPMGYIGEPEEIAAVAAWLASKEASYVTGITLFADGGMTLYPSFQAGRG

SEQ ID NO: 395 - DNA, 783 bp, Artificial Sequence
  Variant of Glucose Dehydrogenase from Bacillus subtilis
atgtatccggatttaaaaggaaaagtcgtcgctattacaggagctgctagcgggctcggaaaggcgatggccattcgcttcggcaaggagcaggcaaaagtggttatcaactattatagtaataaacaagatccgaacgcggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggtacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgtcgaagggcattcgcgtcaataatattgggccaggtgcgatcaacacgacgaacaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 396 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNAVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLNVHYAASKGGMKLMTKTLALEYASKGIRVNNIGPGAINTTNNAERWADPKQKADVESMIPMGYIGEPEEIAAVAAWLASKEASYVTGITLFADGGMTLYPSFQAGRG

SEQ ID NO: 397 - DNA, 783 bp, Artificial Sequence
  Variant of Glucose Dehydrogenase from Bacillus subtilis
atgtatccggatttaaaaggaaaagtcgtcgctattacaggagctgctagcgggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtctgcaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgattgaagtgattccttggccgttaaacgtccactatgccgcaagtaaaggcgggatgaagctgatgacaaaaacattagcgttggaatacgcgccgaagggcattcgcgtcaataatattgggccaggtgcgatcaacacgacgatcaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 398 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVCNPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTINAERWADPKQKADVESMIPMGYIGEPEEIAAVAAWLASKEASYVTGITLFADGGMTLYPSFQAGRG

SEQ ID NO: 399 - DNA, 783 bp, Artificial Sequence
  Variant of Glucose Dehydrogenase from Bacillus subtilis
atgtatccggatttaaaaggaaaagtcgtcgctattacaggagctgctactgggctcggaaaagcgatggccattcgcttcggcaaggagcaggcaaaagtggttatcaactattatagtaataaacaagatccgaacgaggtagccgaactggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttacgcgtccactatgccgcaagtaaaggcgggatgaagctgatgacaaaaacattagcgttggaatacgcgccgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgctgccttcattccaggcaggccgcggt

SEQ ID NO: 400 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNEVAELVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLRVHYAASKGGMKLMTKTLALEYAPKGIRVNNIGPGAINTTINAEKWADPKQKADVESMIPMGYIGEPEEIAAVAAWLASKEASYVTGITLFADGGMTLLPSFQAGRG

SEQ ID NO: 401 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgcaaatcctgtgccatctcacgaaatgccgctcaaggattgggataaagtcatcggtacgaacttaacgggtgcctttttaggaagccgtgaagcgattaaatatttcgtagaaaacgatatcaagggaaatgtcattaacatgtccagtgtgatcgaagtgattccttggccgttacgcgtccactatgccgcaagtaaaggcgggatgaagctgatgacaaaaacattagcgttggaatacgcgtcgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgggtccttcattccaggcaggccgcggt

SEQ ID NO: 402 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNEVKEEVIKAGGEAVVVQGDVTKEEDVKNIVQTAIKEFGTLDIMINNAGVANPVPSHEMPLKDWDKVIGTNLTGAFLGSREAIKYFVENDIKGNVINMSSVIEVIPWPLRVHYAASKGGMKLMTKTLALEYASKGIRVNNIGPGAINTTINAEKWADPKQKADVESMIPMGYIGEPEEIAAVAAWLASKEASYVTGITLFADGGMTLGPSFQAGRG

SEQ ID NO: 403 - DNA, 783 bp, Artificial Sequence
  Variant of Glucose Dehydrogenase from Bacillus subtilis
atgtatccggatttaaaaggaaaagtcgtcgctattacaggagctgctagtgggctcggacgcgcgatggccattcgcttcggcaaggagcaggcaaaagtggttatcaactattatagtaataaacaagatccgaacgaggtaaaggaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcagtaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgaacaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 404 - protein, 261 aa, Artificial Sequence
  Variant of Glucose Dehydrogenase from Bacillus subtilis
MYPDLKGKVVAITGAASGLGRAMAIRFGKEQAKVVINYYSNKQDPNEVKEEVIKAGGEAVVVQGDVTKEEDVKNIVQTAIKEFGTLDIMINNAGVSNPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTNNAEKWADPKQKADVESMIPMGYIGEPEEIAAVAAWLASKEASYVTGITLFADGGMTLYPSFQAGRG

SEQ ID NO: 405 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaaaacccgaacgcggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgattgaagtgattccttggccgttaaacgtccactatgccgcaagtaaaggcgggatgaagctgatgacaaaaacattagcgttggaatacgcgccgaagggcattcgcgtcaataatattgggccaggtgcgatcaacacgacgaacaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 406 - protein, 261 aa, Artificial Sequence
  Variant of Glucose Dehydrogenase from Bacillus subtilis
MYPDLKGKVVAITGAATGLGKAMAIRFGKEQAKVVINYYSNKQNPNAVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTNNAERWADPKQKADVESMIPMGYIGEPEEIAAVAAWLASKEASYVTGITLFADGGMTLYPSFQAGRG

SEQ ID NO: 407 - DNA, 783 bp, Artificial Sequence
  Variant of Glucose Dehydrogenase from Bacillus subtilis
atgtatccggatttaaaaggaaaagtcgtcgctattacaggagctgctagcgggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgcaaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgactgaagtgattccttggccgttaaacgtccactatgccgcaagtaaaggcgggatgaagctgatgacaaaaacattagcgttggaatacgcgccgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 408 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVANPVPSHEMPLKDWDKVIGTNLTGAFLGSREAIKYFVENDIKGNVINMSSVTEVIPWPLNVHYAASKGGMKLMTKTLALEYAPKGIRVNNIGPGAINTTGNAERWADPKQKADVESMIPMGYIGEPEEIAAVAAWLASKEASYVTGITLFADGGMTLYPSFQAGRG

SEQ ID NO: 409 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcaccaatcctgtgccatctcacgaaatgccgctcaaggattgggataaagtcatcggtacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgcgtccttcattccaggcaggccgcggt

SEQ ID NO: 410 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNEVKEEVIKAGGEAVVVQGDVTKEEDVKNIVQTAIKEFGTLDIMINNAGVTNPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTGNAERWADPKQKADVESMIPMGYIGEPEEIAAVAAWLASKEASYVTGITLFADGGMTLRPSFQAGRG

SEQ ID NO: 411 - DNA, 783 bp, Artificial Sequence
  Variant of Glucose Dehydrogenase from Bacillus subtilis
atgtatccggatttaaaaggaaaagtcgtcgctattacaggagctgctagtgggctcggacgcgcgatggccattcgcttcggcaaggagcaggcaaaagtggttatcaactattatagtaataaacaagatccgaacgaggtaaaggaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcagtaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 412 - protein, 261 aa, Artificial Sequence
  Variant of Glucose Dehydrogenase from Bacillus subtilis
MYPDLKGKVVAITGAASGLGRAMAIRFGKEQAKVVINYYSNKQDPNEVKEEVIKAGGEAVVVQGDVTKEEDVKNIVQTAIKEFGTLDIMINNAGVSNPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTINAEKWADPKQKADVESMIPMGYIGEPEEIAAVAAWLASKEASYVTGITLFADGGMTLYPSFQAGRG

SEQ ID NO: 413 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaggaactggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcagtaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 414 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKELVIKAGGEAVVVQGDVTKEEDVKNIVQTAIKEFGTLDIMINNAGVSNPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTINAEKWADPKQKADVESMIPMGYIGEPEEIAAVAAWLASKEASYVTGITLFADGGMTLYPSFQAGRG

SEQ ID NO: 415 - DNA, 783 bp, Artificial Sequence
  Variant of Glucose Dehydrogenase from Bacillus subtilis
atgtatccggatttaaaaggaaaagtcgtcgctattacaggagctgctactgggctcggaaaagcgatggccattcgcttcggcaaggagcaggcaaaagtggttatcaactattatagtaatacgcaagatccgaacgaggtaaaggaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgatcaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 416 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNEVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTINAEKWADPKQKADVESMIPMGYIGEPEEIAAVAAWLASKEASYVTGITLFADGGMTLYPSFQAGRG

SEQ ID NO: 417 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgcggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcagcaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgatcgaagtgattccttggccgttaaacgtccactatgccgcaagtaaaggcgggatgaagctgatgacaaaaacattagcgttggaatacgcgccgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 418 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNAVKEEVIKAGGEAVVVQGDVTKEEDVKNIVQTAIKEFGTLDIMINNAGVSNPVPSHEMPLKDWDKVIATNLTGAFLGSREAIKYFVENDIKGNVINMSSVIEVIPWPLNVHYAASKGGMKLMTKTLALEYAPKGIRVNNIGPGAINTTINAEKWADPKQKADVESMIPMGYIGEPEEIAAVAAWLASKEASYVTGITLFADGGMTLYPSFQAGRG

SEQ ID NO: 419 - DNA, 783 bp, Artificial Sequence
  Variant of Glucose Dehydrogenase from Bacillus subtilis
atgtatccggatttaaaaggaaaagtcgtcgctattacaggagctgctactgggctcggaaaagcgatggccattcgcttcggcaaggagcaggcaaaagtggttatcaactattatagtaataaacaagatccgaacgaggtaaaggaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgaacaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgtggt

SEQ ID NO: 420 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNEVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTNNAEKWADPKQKADVESMIPMGYIGEPEEIAAVAAWLASKEASYVTGITLFADGGMTLYPSFQAGRG

SEQ ID NO: 421 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacgaggtaaaagaagcggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgcgtccttcattccaggcaggccgcggt

SEQ ID NO: 422 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNEVKEAVIKAGGEAVVVQGDVTKEEDVKNIVQTAIKEFGTLDIMINNAGVENPVPSHEMPLKDWDKVIATNLTGAFLGSREAIKYFVENDIKGNVINMSSVIEVIPWPLNVHYAASKGGMKLMTKTLALEYAPKGIRVNNIGPGAINTTINAEKWADPKQKADVESMIPMGYIGEPEEIAAVAAWLASKEASYVTGITLFADGGMTLRPSFQAGRG

SEQ ID NO: 423 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagacccgaacagtgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaacgtccactatgccgcaagtaaaggcgggatgaagctgatgacaaaaacattagcgttggaatacgcgtcgaagggcattcgcgtcaataatattgggccaggtgcgatcaacacgacgggtaatgctgagaagtgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 424 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNSVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLNVHYAASKGGMKLMTKTLALEYASKGIRVNNIGPGAINTTGNAEKWADPKQKADVESMIPMGYIGEPEEIAAVAAWLASKEASYVTGITLFADGGMTLYPSFQAGRG

SEQ ID NO: 425 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagacccgaacagtgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 426 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNSVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTINAEKWADPKQKADVESMIPMGYIGEPEEIAAVAAWLASKEASYVTGITLFADGGMTLYPSFQAGRG

SEQ ID NO: 427 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagacccgaacagtgtaaaagaagcggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgcaaatcctgtgccatctcacgaaatgccgctcaaggattgggataaagtcatcggtacgaacttaacgggtgcctttttaggaagccgtgaagcgattaaatatttcgtagaaaacgatatcaagggaaatgtcattaacatgtccagtgtgatcgaagtgattccttggccgttaaacgtccactatgccgcaagtaaaggcgggatgaagctgatgacaaaaacattagcgttggaatacgcgccgaagggcattcgcgtcaataatattgggccaggtgcgatcaacacgacgatcaatgctgagaagtgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 428 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNSVKEAVIKAGGEAVVVQGDVTKEEDVKNIVQTAIKEFGTLDIMINNAGVANPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTINAEKWADPKQKADVESMIPMGYIGEPEEIAAVAAWLASKEASYVTGITLFADGGMTLYPSFQAGRG

SEQ ID NO: 429 - DNA, 783 bp, Artificial Sequence
  Variant of Glucose Dehydrogenase from Bacillus subtilis
atgtatccggatttaaaaggaaaagtcgtcgctattacaggagctgctagcgggctcggaaaggcgatggccattcgcttcggcaaggagcaggcaaaagtggttatcaactattatagtaataaacaaaacccgaacagtgtaaaagaagcggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgatcgaagtgattccttggccgttaaacgtccactatgccgcaagtaaaggcgggatgaagctgatgacaaaaacattagcgttggaatacgcgtcgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgagtccttcattccaggcaggccgcggt

SEQ ID NO: 430 - protein, 261 aa, Artificial Sequence
  Variant of Glucose Dehydrogenase from Bacillus subtilis
MYPDLKGKVVAITGAASGLGKAMAIRFGKEQAKVVINYYSNKQNPNSVKEAVIKAGGEAVVVQGDVTKEEDVKNIVQTAIKEFGTLDIMINNAGVENPVPSHEMPLKDWDKVIATNLTGAFLGSREAIKYFVENDIKGNVINMSSVIEVIPWPLNVHYAASKGGMKLMTKTLALEYASKGIRVNNIGPGAINTTINAEKWADPKQKADVESMIPMGYIGEPEEIAAVAAWLASKEASYVTGITLFADGGMTLSPSFQAGRG

SEQ ID NO: 431 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacaacgtatccttcattccaggcaggccgcggt

SEQ ID NO: 432 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTINAEKWADPKQKADVESMIPMGYIGEPEEIAAVAAWLASKEASYVTGITLFADGGMTTYPSFQAGRG

SEQ ID NO: 433 - DNA, 783 bp, Artificial Sequence
  Variant of Glucose Dehydrogenase from Bacillus subtilis
atgtatccggatttaaaaggaaaagtcgtcgctattacaggagctgctagcgggctcggaaaggcgatggccattcgcttcggcaaggagcaggcaaaagtggttatcaactattatagtaataaacaaaacccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtctgcaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttacgcgtccactatgccgcaagtaaaggcgggatgaagctgatgacaaaaacattagcgttggaatacgcgtcgaagggcattcgcgtcaataatattgggccaggtgcgatcaacacgacgatcaatgctgagaagtgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 434 - protein, 261 aa, Artificial Sequence
  Variant of Glucose Dehydrogenase from Bacillus subtilis
MYPDLKGKVVAITGAASGLGKAMAIRFGKEQAKVVINYYSNKQNPNEVKEEVIKAGGEAVVVQGDVTKEEDVKNIVQTAIKEFGTLDIMINNAGVCNPVPSHEMPLKDWDKVIGTNLTGAFLGSREAIKYFVENDIKGNVINMSSVIEVIPWPLRVHYAASKGGMKLMTKTLALEYASKGIRVNNIGPGAINTTINAEKWADPKQKADVESMIPMGYIGEPEEIAAVAAWLASKEASYVTGITLFADGGMTLYPSFQAGRG

SEQ ID NO: 435 - DNA, 783 bp, Artificial Sequence
  Variant of Glucose Dehydrogenase from Bacillus subtilis
atgtatccggatttaaaaggaaaagtcgtcgctattacaggagctgctagcgggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcaccaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgattgaagtgattccttggccgttaaacgtccactatgccgcaagtaaaggcgggatgaagctgatgacaaaaacattagcgttggaatacgcgtcgaagggcattcgcgtcaataatattgggccaggtgcgatcaacacgacgggtaatgctgagaagtgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 436 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVTNPVPSHEMPLKDWDKVIGTNLTGAFLGSREAIKYFVENDIKGNVINMSSVIEVIPWPLNVHYAASKGGMKLMTKTLALEYASKGIRVNNIGPGAINTTGNAEKWADPKQKADVESMIPMGYIGEPEEIAAVAAWLASKEASYVTGITLFADGGMTLYPSFQAGRG

SEQ ID NO: 437 - DNA, 783 bp, Artificial Sequence
  Variant of Glucose Dehydrogenase from Bacillus subtilis
atgtatccggatttaaaaggaaaagtcgtcgctattacaggagctgctactgggctcggacgcgcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcagtaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttacgcgtccactatgccgcaagtaaaggcgggatgaagctgatgacaaaaacattagcgttggaatacgcgccgaagggcattcgcgtcaataatattgggccaggtgcgatcaacacgacgatcaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgtggt

SEQ ID NO: 438 - protein, 261 aa, Artificial Sequence
  Variant of Glucose Dehydrogenase from Bacillus subtilis
MYPDLKGKVVAITGAATGLGRAMAIRFGKEQAKVVINYYSNKQDPNEVKEEVIKAGGEAVVVQGDVTKEEDVKNIVQTAIKEFGTLDIMINNAGVSNPVPSHEMPLKDWDKVIGTNLTGAFLGSREAIKYFVENDIKGNVINMSSVIEVIPWPLRVHYAASKGGMKLMTKTLALEYAPKGIRVNNIGPGAINTTINAEKWADPKQKADVESMIPMGYIGEPEEIAAVAAWLASKEASYVTGITLFADGGMTLYPSFQAGRG

SEQ ID NO: 439 - DNA, 783 bp, Artificial Sequence
  Variant of Glucose Dehydrogenase from Bacillus subtilis
atgtatccggatttaaaaggaaaagtcgtcgctattacaggagctgctactgggctcggacgcgcgatggccattcgcttcggcaaggagcaggcaaaagtggttatcaactattatagtaataaacaagatccgaacgaggtagccgaactggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 440 - protein, 261 aa, Artificial Sequence
  Variant of Glucose Dehydrogenase from Bacillus subtilis
MYPDLKGKVVAITGAATGLGRAMAIRFGKEQAKVVINYYSNKQDPNEVAELVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTINAEKWADPKQKADVESMIPMGYIGEPEEIAAVAAWLASKEASYVTGITLFADGGMTLYPSFQAGRG

SEQ ID NO: 441 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagacccgaacagtgtaaaagaagcggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtctgcaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 442 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNSVKEAVIKAGGEAVVVQGDVTKEEDVKNIVQTAIKEFGTLDIMINNAGVCNPVPSHEMPLKDWDKVIATNLTGAFLGSREAIKYFVENDIKGNVINMSSVIEVIPWPLNVHYAASKGGMKLMTKTLALEYAPKGIRVNNIGPGAINTTINAEKWADPKQKADVESMIPMGYIGEPEEIAAVAAWLASKEASYVTGITLFADGGMTLYPSFQAGRG

SEQ ID NO: 443 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacgcggtaaaagaagcggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 444 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNAVKEAVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTINAEKWADPKQKADVESMIPMGYIGEPEEIAAVAAWLASKEASYVTGITLFADGGMTLYPSFQAGRG

SEQ ID NO: 445 - DNA, 783 bp, Artificial Sequence
  Variant of Glucose Dehydrogenase from Bacillus subtilis
atgtatccggatttaaaaggaaaagtcgtcgctattacaggagctgctactgggctcggacgcgcgatggccattcgcttcggcaaggagcaggcaaaagtggttatcaactattatagtaataaacaagatccgaacgaggtaaaggaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcagtaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgaacaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggcggtggt

SEQ ID NO: 446 - protein, 261 aa, Artificial Sequence
  Variant of Glucose Dehydrogenase from Bacillus subtilis
MYPDLKGKVVAITGAATGLGRAMAIRFGKEQAKVVINYYSNKQDPNEVKEEVIKAGGEAVVVQGDVTKEEDVKNIVQTAIKEFGTLDIMINNAGVSNPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTNNAEKWADPKQKADVESMIPMGYIGEPEEIAAVAAWLASKEASYVTGITLFADGGMTLYPSFQAGGG

SEQ ID NO: 447 - DNA, 783 bp, Artificial Sequence
  Variant of Glucose Dehydrogenase from Bacillus subtilis
atgtatccggatttaaaaggaaaagtcgtcgctattacaggagctgctactgggctcggacgcgcgatggccattcgcttcggcaaggagcaggcaaaagtggttatcaactattatagtaataaacaagatccgaacgaggtagccgaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcagtaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttacgcgtccactatgccgcaagtaaaggcgggatgaagctgatgacaaaaacattagcgttggaatacgcgccgaagggcattcgcgtcaataatattgggccaggtgcgatcaacacgacgatcaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggcggtggt

SEQ ID NO: 448 - protein, 261 aa, Artificial Sequence
  Variant of Glucose Dehydrogenase from Bacillus subtilis
MYPDLKGKVVAITGAATGLGRAMAIRFGKEQAKVVINYYSNKQDPNEVAEEVIKAGGEAVVVQGDVTKEEDVKNIVQTAIKEFGTLDIMINNAGVSNPVPSHEMPLKDWDKVIGTNLTGAFLGSREAIKYFVENDIKGNVINMSSVIEVIPWPLRVHYAASKGGMKLMTKTLALEYAPKGIRVNNIGPGAINTTINAEKWADPKQKADVESMIPMGYIGEPEEIAAVAAWLASKEASYVTGITLFADGGMTLYPSFQAGGG

SEQ ID NO: 449 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcagcaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgattgaagtgattccttggccgttacgcgtccactatgccgcaagtaaaggcgggatgaagctgatgacaaaaacattagcgttggaatacgcgccgaagggcattcgcgtcaataatattgggccaggtgcgatcaacacgacgaacaatgctgagaagtgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 450 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNEVKEEVIKAGGEAVVVQGDVTKEEDVKNIVQTAIKEFGTLDIMINNAGVSNPVPSHEMPLKDWDKVIGTNLTGAFLGSREAIKYFVENDIKGNVINMSSVIEVIPWPLRVHYAASKGGMKLMTKTLALEYAPKGIRVNNIGPGAINTTNNAEKWADPKQKADVESMIPMGYIGEPEEIAAVAAWLASKEASYVTGITLFADGGMTLYPSFQAGRG

SEQ ID NO: 451 - DNA, 783 bp, Artificial Sequence
  Variant of Glucose Dehydrogenase from Bacillus subtilis
atgtatccggatttaaaaggaaaagtcgtcgctattacaggagctgctagcgggctcggaaaggcgatggccattcgcttcggcaaggagcaggcaaaagtggttatcaactattatagtaataaacaagatccgaacgaggtaaaagaagcggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtctgcaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttacgcgtccactatgccgcaagtaaaggcgggatgaagctgatgacaaaaacattagcgttggaatacgcgtcgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 452 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEAVIKAGGEAVVVQGDVTKEEDVKNIVQTAIKEFGTLDIMINNAGVCNPVPSHEMPLKDWDKVIGTNLTGAFLGSREAIKYFVENDIKGNVINMSSVIEVIPWPLRVHYAASKGGMKLMTKTLALEYASKGIRVNNIGPGAINTTINAEKWADPKQKADVESMIPMGYIGEPEEIAAVAAWLASKEASYVTGITLFADGGMTLYPSFQAGRG

SEQ ID NO: 453 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgattgaagtgattccttggccgttaaacgtccactatgccgcaagtaaaggcgggatgaagctgatgacaaaaacattagcgttggaatacgcgccgaagggcattcgcgtcaataatattgggccaggtgcgatcaacacgacgaacaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 454 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNEVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTNNAERWADPKQKADVESMIPMGYIGEPEEIAAVAAWLASKEASYVTGITLFADGGMTLYPSFQAGRG

SEQ ID NO: 455 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagacccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgggtaatgctgagaagtgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 456 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNEVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTGNAEKWADPKQKADVESMIPMGYIGEPEEIAAVAAWLASKEASYVTGITLFADGGMTLYPSFQAGRG

SEQ ID NO: 457 - DNA, 783 bp, Artificial Sequence
  Variant of Glucose Dehydrogenase from Bacillus subtilis
atgtatccggatttaaaaggaaaagtcgtcgctattacaggagctgctagtgggctcggaaaagcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcagtaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 458 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVSNPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTINAEKWADPKQKADVESMIPMGYIGEPEEIAAVAAWLASKEASYVTGITLFADGGMTLYPSFQAGRG

SEQ ID NO: 459 - DNA, 783 bp, Artificial Sequence
  Variant of Glucose Dehydrogenase from Bacillus subtilis
atgtatccggatttaaaaggaaaagtcgtcgctattacaggagctgctagcgggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcaccaatcctgtgccatctcacgaaatgccgctcaaggattgggataaagtcatcggtacgaacttaacgggtgcctttttaggaagccgtgaagcgattaaatatttcgtagaaaacgatatcaagggaaatgtcattaacatgtccagtgtgatcgaagtgattccttggccgttacaggtccactatgccgcaagtaaaggcgggatgaagctgatgacaaaaacattagcgttggaatacgcgtcgaagggcattcgcgtcaataatattgggccaggtgcgatcaacacgacgatcaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 460 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVTNPVPSHEMPLKDWDKVIGTNLTGAFLGSREAIKYFVENDIKGNVINMSSVIEVIPWPLQVHYAASKGGMKLMTKTLALEYASKGIRVNNIGPGAINTTINAERWADPKQKADVESMIPMGYIGEPEEIAAVAAWLASKEASYVTGITLFADGGMTLYPSFQAGRG

SEQ ID NO: 461 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgcaaatcctgtgccatctcacgaaatgccgctcaaggattgggataaagtcatcggtacgaacttaacgggtgcctttttaggaagccgtgaagcgattaaatatttcgtagaaaacgatatcaagggaaatgtcattaacatgtccagtgtgattgaagtgattccttggccgttaaacgtccactatgccgcaagtaaaggcgggatgaagctgatgacaaaaacattagcgttggaatacgcgccgaagggcattcgcgtcaataatattgggccaggtgcgatcaacacgacgggtaatgctgagaagtgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 462 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVANPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTGNAEKWADPKQKADVESMIPMGYIGEPEEIAAVAAWLASKEASYVTGITLFADGGMTLYPSFQAGRG

SEQ ID NO: 463 - DNA, 783 bp, Artificial Sequence
  Variant of Glucose Dehydrogenase from Bacillus subtilis
atgtatccggatttaaaaggaaaagtcgtcgctattacaggagctgctagcgggctcggaaaggcgatggccattcgcttcggcaaggagcaggcaaaagtggttatcaactattatagtaataaacaaaacccgtggctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtctgcaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttacgcgtccactatgccgcaagtaaaggcgggatgaagctgatgacaaaaacattagcgttggaatacgcgccgaagggcattcgcgtcaataatattgggccaggtgcgatcaacacgacgggtaatgctgagaagtgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 464 - protein, 261 aa, Artificial Sequence
  Variant of Glucose Dehydrogenase from Bacillus subtilis
MYPDLKGKVVAITGAASGLGKAMAIRFGKEQAKVVINYYSNKQNPWLVKEEVIKAGGEAVVVQGDVTKEEDVKNIVQTAIKEFGTLDIMINNAGVCNPVPSHEMPLKDWDKVIGTNLTGAFLGSREAIKYFVENDIKGNVINMSSVIEVIPWPLRVHYAASKGGMKLMTKTLALEYAPKGIRVNNIGPGAINTTGNAEKWADPKQKADVESMIPMGYIGEPEEIAAVAAWLASKEASYVTGITLFADGGMTLYPSFQAGRG

SEQ ID NO: 465 - DNA, 783 bp, Artificial Sequence
  Variant of Glucose Dehydrogenase from Bacillus subtilis
atgtatccggatttaaaaggaaaagtcgtcgctattacaggagctgctagtgggctcggaaaagcgatggccattcgcttcggcaaggagcaggcaaaagtggttatcaactattatagtaataaacaagatccgaacgaggtaaaggaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcagtaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgaacaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 466 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVSNPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTNNAEKWADPKQKADVESMIPMGYIGEPEEIAAVAAWLASKEASYVTGITLFADGGMTLYPSFQAGRG

SEQ ID NO: 467 - DNA, 783 bp, Artificial Sequence
  Variant of Glucose Dehydrogenase from Bacillus subtilis
atgtatccggatttaaaaggaaaagtcgtcgctattacaggagctgctactgggctcggaaaggcgatggccattcgcttcggcaaggagcaggcaaaagtggttatcaactattatagtaatacgcaagatccgaacgaggtagccgaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgaacaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggcggtggt

SEQ ID NO: 468 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNEVAEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTNNAEKWADPKQKADVESMIPMGYIGEPEEIAAVAAWLASKEASYVTGITLFADGGMTLYPSFQAGGG

SEQ ID NO: 469 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgattgaagtgattccttggccgttaaacgtccactatgccgcaagtaaaggcgggatgaagctgatgacaaaaacattagcgttggaatacgcgtcgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgagtccttcattccaggcaggccgcggt

SEQ ID NO: 470 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVIEVIPWPLNVHYAASKGGMKLMTKTLALEYASKGIRVNNIGPGAINTTGNAERWADPKQKADVESMIPMGYIGEPEEIAAVAAWLASKEASYVTGITLFADGGMTLSPSFQAGRG

SEQ ID NO: 471 - DNA, 783 bp, Artificial Sequence
  Variant of Glucose Dehydrogenase from Bacillus subtilis
atgtatccggatttaaaaggaaaagtcgtcgctattacaggagctgctactgggctcggaaaagcgatggccattcgcttcggcaaggagcaggcaaaagtggttatcaactattatagtaataaacaagatccgaacgaggtagccgaactggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgtggt

SEQ ID NO: 472 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNEVAELVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTINAEKWADPKQKADVESMIPMGYIGEPEEIAAVAAWLASKEASYVTGITLFADGGMTLYPSFQAGRG

SEQ ID NO: 473 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaaaacccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgattgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 474 - protein, 261 aa, Artificial Sequence
  Variant of Glucose Dehydrogenase from Bacillus subtilis
MYPDLKGKVVAITGAATGLGKAMAIRFGKEQAKVVINYYSNKQNPNEVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTINAEKWADPKQKADVESMIPMGYIGEPEEIAAVAAWLASKEASYVTGITLFADGGMTLYPSFQAGRG

SEQ ID NO: 475 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttacaggtccactatgccgcaagtaaaggcgggatgaagctgatgacaaaaacattagcgttggaatacgcgccgaagggcattcgcgtcaataatattgggccaggtgcgatcaacacgacgaacaatgctgagaagtgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 476 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLQVHYAASKGGMKLMTKTLALEYAPKGIRVNNIGPGAINTTNNAEKWADPKQKADVESMIPMGYIGEPEEIAAVAAWLASKEASYVTGITLFADGGMTLYPSFQAGRG

SEQ ID NO: 477 - DNA, 783 bp, Artificial Sequence
  Variant of Glucose Dehydrogenase from Bacillus subtilis
atgtatccggatttaaaaggaaaagtcgtcgctattacaggagctgctactgggctcggacgcgcgatggccattcgcttcggcaaggagcaggcaaaagtggttatcaactattatagtaataaacaagatccgaacgaggtagccgaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgatcaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 478 - protein, 261 aa, Artificial Sequence
  Variant of Glucose Dehydrogenase from Bacillus subtilis
MYPDLKGKVVAITGAATGLGRAMAIRFGKEQAKVVINYYSNKQDPNEVAEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTINAEKWADPKQKADVESMIPMGYIGEPEEIAAVAAWLASKEASYVTGITLFADGGMTLYPSFQAGRG

SEQ ID NO: 479 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagacccgtggctggtaaaagaagcggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcaccaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgtcgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 480 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPWLVKEAVIKAGGEAVVVQGDVTKEEDVKNIVQTAIKEFGTLDIMINNAGVTNPVPSHEMPLKDWDKVIATNLTGAFLGSREAIKYFVENDIKGNVINMSSVIEVIPWPLNVHYAASKGGMKLMTKTLALEYASKGIRVNNIGPGAINTTINAEKWADPKQKADVESMIPMGYIGEPEEIAAVAAWLASKEASYVTGITLFADGGMTLYPSFQAGRG

SEQ ID NO: 481 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgcggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 482 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNAVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVIEVIPWPLNVHYAASKGGMKLMTKTLALEYAPKGIRVNNIGPGAINTTINAEKWADPKQKADVESMIPMGYIGEPEEIAAVAAWLASKEASYVTGITLFADGGMTLYPSFQAGRG

SEQ ID NO: 483 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcaccaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgtcgaagggcattcgcgtcaataatattgggccaggtgcgatcaacacgacgaacaatgctgagaagtgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 484 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVTNPVPSHEMPLKDWDKVIGTNLTGAFLGSREAIKYFVENDIKGNVINMSSVIEVIPWPLNVHYAASKGGMKLMTKTLALEYASKGIRVNNIGPGAINTTNNAEKWADPKQKADVESMIPMGYIGEPEEIAAVAAWLASKEASYVTGITLFADGGMTLYPSFQAGRG

SEQ ID NO: 485 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagacccgaacgcggtaaaagaagcggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcaccaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgattgaagtgattccttggccgttaaacgtccactatgccgcaagtaaaggcgggatgaagctgatgacaaaaacattagcgttggaatacgcgccgaagggcattcgcgtcaataatattgggccaggtgcgatcaacacgacgggtaatgctgagaagtgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 486 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNAVKEAVIKAGGEAVVVQGDVTKEEDVKNIVQTAIKEFGTLDIMINNAGVTNPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTGNAEKWADPKQKADVESMIPMGYIGEPEEIAAVAAWLASKEASYVTGITLFADGGMTLYPSFQAGRG

SEQ ID NO: 487 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttacgcgtccactatgccgcaagtaaaggcgggatgaagctgatgacaaaaacattagcgttggaatacgcgccgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgagtccttcattccaggcaggccgcggt

SEQ ID NO: 488 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLRVHYAASKGGMKLMTKTLALEYAPKGIRVNNIGPGAINTTINAEKWADPKQKADVESMIPMGYIGEPEEIAAVAAWLASKEASYVTGITLFADGGMTLSPSFQAGRG

SEQ ID NO: 489 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtctgcaatcctgtgccatctcacgaaatgccgctcaaggattgggataaagtcatcggtacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 490 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVCNPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTINAEKWADPKQKADVESMIPMGYIGEPEEIAAVAAWLASKEASYVTGITLFADGGMTLYPSFQAGRG

SEQ ID NO: 491 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttacgcgtccactatgccgcaagtaaaggcgggatgaagctgatgacaaaaacattagcgttggaatacgcgtcgaagggcattcgcgtcaataatattgggccaggtgcgatcaacacgacgggtaatgctgagaagtgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 492 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNEVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLRVHYAASKGGMKLMTKTLALEYASKGIRVNNIGPGAINTTGNAEKWADPKQKADVESMIPMGYIGEPEEIAAVAAWLASKEASYVTGITLFADGGMTLYPSFQAGRG

SEQ ID NO: 493 - DNA, 783 bp, Artificial Sequence
  Variant of Glucose Dehydrogenase from Bacillus subtilis
atgtatccggatttaaaaggaaaagtcgtcgctattacaggagctgctagcgggctcggaaaggcgatggccattcgcttcggcaaggagcaggcaaaagtggttatcaactattatagtaataaacaagatccgaacgaggtaaaagaagcggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtctgcaatcctgtgccatctcacgaaatgccgctcaaggattgggataaagtcatcggtacgaacttaacgggtgcctttttaggaagccgtgaagcgattaaatatttcgtagaaaacgatatcaagggaaatgtcattaacatgtccagtgtgatcgaagtgattccttggccgttacaggtccactatgccgcaagtaaaggcgggatgaagctgatgacaaaaacattagcgttggaatacgcgccgaagggcattcgcgtcaataatattgggccaggtgcgatcaacacgacgggtaatgctgagaagtgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgggtccttcattccaggcaggccgcggt

SEQ ID NO: 494 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEAVIKAGGEAVVVQGDVTKEEDVKNIVQTAIKEFGTLDIMINNAGVCNPVPSHEMPLKDWDKVIGTNLTGAFLGSREAIKYFVENDIKGNVINMSSVIEVIPWPLQVHYAASKGGMKLMTKTLALEYAPKGIRVNNIGPGAINTTGNAEKWADPKQKADVESMIPMGYIGEPEEIAAVAAWLASKEASYVTGITLFADGGMTLGPSFQAGRG

SEQ ID NO: 495 - DNA, 783 bp, Artificial Sequence
  Variant of Glucose Dehydrogenase from Bacillus subtilis
atgtatccggatttaaaaggaaaagtcgtcgctattacaggagctgctactgggctcggacgcgcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 496 - protein, 261 aa, Artificial Sequence
  Variant of Glucose Dehydrogenase from Bacillus subtilis
MYPDLKGKVVAITGAATGLGRAMAIRFGKEQAKVVINYYSNKQDPNEVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTINAEKWADPKQKADVESMIPMGYIGEPEEIAAVAAWLASKEASYVTGITLFADGGMTLYPSFQAGRG

SEQ ID NO: 497 - DNA, 783 bp, Artificial Sequence
  Variant of Glucose Dehydrogenase from Bacillus subtilis
atgtatccggatttaaaaggaaaagtcgtcgctattacaggagctgctagcgggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgcaaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgatcaatgctgagaagtgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 498 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVANPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTINAEKWADPKQKADVESMIPMGYIGEPEEIAAVAAWLASKEASYVTGITLFADGGMTLYPSFQAGRG

SEQ ID NO: 499 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaaaacccgtgggaggtaaaagaagcggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcaccaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttacgcgtccactatgccgcaagtaaaggcgggatgaagctgatgacaaaaacattagcgttggaatacgcgccgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgggtccttcattccaggcaggccgcggt

SEQ ID NO: 500 - protein, 261 aa, Artificial Sequence
  Variant of Glucose Dehydrogenase from Bacillus subtilis
MYPDLKGKVVAITGAASGLGKAMAIRFGKEQAKVVINYYSNKQNPWEVKEAVIKAGGEAVVVQGDVTKEEDVKNIVQTAIKEFGTLDIMINNAGVTNPVPSHEMPLKDWDKVIGTNLTGAFLGSREAIKYFVENDIKGNVINMSSVIEVIPWPLRVHYAASKGGMKLMTKTLALEYAPKGIRVNNIGPGAINTTGNAERWADPKQKADVESMIPMGYIGEPEEIAAVAAWLASKEASYVTGITLFADGGMTLGPSFQAGRG

SEQ ID NO: 501 - DNA, 783 bp, Artificial Sequence
  Variant of Glucose Dehydrogenase from Bacillus subtilis
atgtatccggatttaaaaggaaaagtcgtcgctattacaggagctgctagcgggctcggaaaggcgatggccattcgcttcggcaaggagcaggcaaaagtggttatcaactattatagtaataaacaagatccgaacgaggtaaaagaagcggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgactgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgatcaatgctgagaagtgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgagtccttcattccaggcaggccgcggt

SEQ ID NO: 502 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEAVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVTEVIPWPLNVHYAASKGGMKLMTKTLALEYAPKGIRVNNIGPGAINTTINAEKWADPKQKADVESMIPMGYIGEPEEIAAVAAWLASKEASYVTGITLFADGGMTLSPSFQAGRG

SEQ ID NO: 503 - DNA, 783 bp, Artificial Sequence
  Variant of Glucose Dehydrogenase from Bacillus subtilis
atgtatccggatttaaaaggaaaagtcgtcgctattacaggagctgctactgggctcggacgcgcgatggccattcgcttcggcaaggagcaggcaaaagtggttatcaactattatagtaatacgcaagatccgaacgaggtaaaggaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttacgcgtccactatgccgcaagtaaaggcgggatgaagctgatgacaaaaacattagcgttggaatacgcgccgaagggcattcgcgtcaataatattgggccaggtgcgatcaacacgacgatcaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggcggtggt

SEQ ID NO: 504 - protein, 261 aa, Artificial Sequence
  Variant of Glucose Dehydrogenase from Bacillus subtilis
MYPDLKGKVVAITGAATGLGRAMAIRFGKEQAKVVINYYSNTQDPNEVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLRVHYAASKGGMKLMTKTLALEYAPKGIRVNNIGPGAINTTINAEKWADPKQKADVESMIPMGYIGEPEEIAAVAAWLASKEASYVTGITLFADGGMTLYPSFQAGGG

SEQ ID NO: 505 - DNA, 783 bp, Artificial Sequence
  Variant of Glucose Dehydrogenase from Bacillus subtilis
atgtatccggatttaaaaggaaaagtcgtcgctattacaggagctgctagcgggctcggaaaggcgatggccattcgcttcggcaaggagcaggcaaaagtggttatcaactattatagtaataaacaaaacccgtgggaggtaaaagaagcggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcaccaatcctgtgccatctcacgaaatgccgctcaaggattgggataaagtcatcggtacgaacttaacgggtgcctttttaggaagccgtgaagcgattaaatatttcgtagaaaacgatatcaagggaaatgtcattaacatgtccagtgtgattgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgggtaatgctgagaagtgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 506 - protein, 261 aa, Artificial Sequence
  Variant of Glucose Dehydrogenase from Bacillus subtilis
MYPDLKGKVVAITGAASGLGKAMAIRFGKEQAKVVINYYSNKQNPWEVKEAVIKAGGEAVVVQGDVTKEEDVKNIVQTAIKEFGTLDIMINNAGVTNPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTGNAEKWADPKQKADVESMIPMGYIGEPEEIAAVAAWLASKEASYVTGITLFADGGMTLYPSFQAGRG

SEQ ID NO: 507 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagacccgaacgcggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgcaaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttacaggtccactatgccgcaagtaaaggcgggatgaagctgatgacaaaaacattagcgttggaatacgcgccgaagggcattcgcgtcaataatattgggccaggtgcgatcaacacgacgatcaatgctgagaagtgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 508 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNAVKEEVIKAGGEAVVVQGDVTKEEDVKNIVQTAIKEFGTLDIMINNAGVANPVPSHEMPLKDWDKVIGTNLTGAFLGSREAIKYFVENDIKGNVINMSSVIEVIPWPLQVHYAASKGGMKLMTKTLALEYAPKGIRVNNIGPGAINTTINAEKWADPKQKADVESMIPMGYIGEPEEIAAVAAWLASKEASYVTGITLFADGGMTLYPSFQAGRG

SEQ ID NO: 509 - DNA, 783 bp, Artificial Sequence
  Variant of Glucose Dehydrogenase from Bacillus subtilis
atgtatccggatttaaaaggaaaagtcgtcgctattacaggagctgctagcgggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgcaaatcctgtgccatctcacgaaatgccgctcaaggattgggataaagtcatcggtacgaacttaacgggtgcctttttaggaagccgtgaagcgattaaatatttcgtagaaaacgatatcaagggaaatgtcattaacatgtccagtgtgactgaagtgattccttggccgttacgcgtccactatgccgcaagtaaaggcgggatgaagctgatgacaaaaacattagcgttggaatacgcgtcgaagggcattcgcgtcaataatattgggccaggtgcgatcaacacgacgggtaatgctgagaagtgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgggtccttcattccaggcaggccgcggt

SEQ ID NO: 510 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVANPVPSHEMPLKDWDKVIGTNLTGAFLGSREAIKYFVENDIKGNVINMSSVTEVIPWPLRVHYAASKGGMKLMTKTLALEYASKGIRVNNIGPGAINTTGNAEKWADPKQKADVESMIPMGYIGEPEEIAAVAAWLASKEASYVTGITLFADGGMTLGPSFQAGRG

SEQ ID NO: 511 - DNA, 783 bp, Artificial Sequence
  Variant of Glucose Dehydrogenase from Bacillus subtilis
atgtatccggatttaaaaggaaaagtcgtcgctattacaggagctgctagcgggctcggaaaggcgatggccattcgcttcggcaaggagcaggcaaaagtggttatcaactattatagtaataaacaaaacccgaacagtgtaaaagaagcggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcagcaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgattgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 512 - protein, 261 aa, Artificial Sequence
  Variant of Glucose Dehydrogenase from Bacillus subtilis
MYPDLKGKVVAITGAASGLGKAMAIRFGKEQAKVVINYYSNKQNPNSVKEAVIKAGGEAVVVQGDVTKEEDVKNIVQTAIKEFGTLDIMINNAGVSNPVPSHEMPLKDWDKVIATNLTGAFLGSREAIKYFVENDIKGNVINMSSVIEVIPWPLNVHYAASKGGMKLMTKTLALEYAPKGIRVNNIGPGAINTTINAEKWADPKQKADVESMIPMGYIGEPEEIAAVAAWLASKEASYVTGITLFADGGMTLYPSFQAGRG

SEQ ID NO: 513 - DNA, 783 bp, Artificial Sequence
  Variant of Glucose Dehydrogenase from Bacillus subtilis
atgtatccggatttaaaaggaaaagtcgtcgctattacaggagctgctactgggctcggaaaagcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgaacaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgctgccttcattccaggcaggccgcggt

SEQ ID NO: 514 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNEVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTNNAEKWADPKQKADVESMIPMGYIGEPEEIAAVAAWLASKEASYVTGITLFADGGMTLLPSFQAGRG

SEQ ID NO: 515 - DNA, 783 bp, Artificial Sequence
  Variant of Glucose Dehydrogenase from Bacillus subtilis
atgtatccggatttaaaaggaaaagtcgtcgctattacaggagctgctagcgggctcggaaaggcgatggccattcgcttcggcaaggagcaggcaaaagtggttatcaactattatagtaataaacaagatccgaacgaggtaaaagaagcggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgatcgaagtgattccttggccgttaaacgtccactatgccgcaagtaaaggcgggatgaagctgatgacaaaaacattagcgttggaatacgcgccgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 516 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEAVIKAGGEAVVVQGDVTKEEDVKNIVQTAIKEFGTLDIMINNAGVENPVPSHEMPLKDWDKVIATNLTGAFLGSREAIKYFVENDIKGNVINMSSVIEVIPWPLNVHYAASKGGMKLMTKTLALEYAPKGIRVNNIGPGAINTTGNAERWADPKQKADVESMIPMGYIGEPEEIAAVAAWLASKEASYVTGITLFADGGMTLYPSFQAGRG

SEQ ID NO: 517 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaaaacccgaacagtgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 518 - protein, 261 aa, Artificial Sequence
  Variant of Glucose Dehydrogenase from Bacillus subtilis
MYPDLKGKVVAITGAATGLGKAMAIRFGKEQAKVVINYYSNKQNPNSVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTGNAERWADPKQKADVESMIPMGYIGEPEEIAAVAAWLASKEASYVTGITLFADGGMTLYPSFQAGRG

SEQ ID NO: 519 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaaaacccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcaccaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgattgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 520 - protein, 261 aa, Artificial Sequence
  Variant of Glucose Dehydrogenase from Bacillus subtilis
MYPDLKGKVVAITGAASGLGKAMAIRFGKEQAKVVINYYSNKQNPNLVKEEVIKAGGEAVVVQGDVTKEEDVKNIVQTAIKEFGTLDIMINNAGVTNPVPSHEMPLKDWDKVIATNLTGAFLGSREAIKYFVENDIKGNVINMSSVIEVIPWPLNVHYAASKGGMKLMTKTLALEYAPKGIRVNNIGPGAINTTINAEKWADPKQKADVESMIPMGYIGEPEEIAAVAAWLASKEASYVTGITLFADGGMTLYPSFQAGRG

SEQ ID NO: 521 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgattgaagtgattccttggccgttacaggtccactatgccgcaagtaaaggcgggatgaagctgatgacaaaaacattagcgttggaatacgcgtcgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 522 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLQVHYAASKGGMKLMTKTLALEYASKGIRVNNIGPGAINTTINAEKWADPKQKADVESMIPMGYIGEPEEIAAVAAWLASKEASYVTGITLFADGGMTLYPSFQAGRG

SEQ ID NO: 523 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaaaacccgaacagtgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgactgaagtgattccttggccgttacaggtccactatgccgcaagtaaaggcgggatgaagctgatgacaaaaacattagcgttggaatacgcgccgaagggcattcgcgtcaataatattgggccaggtgcgatcaacacgacgatcaatgctgagaagtgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 524 - protein, 261 aa, Artificial Sequence
  Variant of Glucose Dehydrogenase from Bacillus subtilis
MYPDLKGKVVAITGAASGLGKAMAIRFGKEQAKVVINYYSNKQNPNSVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVTEVIPWPLQVHYAASKGGMKLMTKTLALEYAPKGIRVNNIGPGAINTTINAEKWADPKQKADVESMIPMGYIGEPEEIAAVAAWLASKEASYVTGITLFADGGMTLYPSFQAGRG

SEQ ID NO: 525 - DNA, 783 bp, Artificial Sequence
  Variant of Glucose Dehydrogenase from Bacillus subtilis
atgtatccggatttaaaaggaaaagtcgtcgctattacaggagctgctactgggctcggaaaagcgatggccattcgcttcggcaaggagcaggcaaaagtggttatcaactattatagtaataaacaagatccgaacgaggtaaaggaactggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcagtaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggcggtggt

SEQ ID NO: 526 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNEVKELVIKAGGEAVVVQGDVTKEEDVKNIVQTAIKEFGTLDIMINNAGVSNPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTINAEKWADPKQKADVESMIPMGYIGEPEEIAAVAAWLASKEASYVTGITLFADGGMTLYPSFQAGGG

SEQ ID NO: 527 - DNA, 783 bp, Artificial Sequence
  Variant of Glucose Dehydrogenase from Bacillus subtilis
atgtatccggatttaaaaggaaaagtcgtcgctattacaggagctgctagtgggctcggacgcgcgatggccattcgcttcggcaaggagcaggcaaaagtggttatcaactattatagtaataaacaagatccgaacgaggtagccgaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgaacaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 528 - protein, 261 aa, Artificial Sequence
  Variant of Glucose Dehydrogenase from Bacillus subtilis
MYPDLKGKVVAITGAASGLGRAMAIRFGKEQAKVVINYYSNKQDPNEVAEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTNNAEKWADPKQKADVESMIPMGYIGEPEEIAAVAAWLASKEASYVTGITLFADGGMTLYPSFQAGRG

SEQ ID NO: 529 - DNA, 783 bp, Artificial Sequence
  Variant of Glucose Dehydrogenase from Bacillus subtilis
atgtatccggatttaaaaggaaaagtcgtcgctattacaggagctgctactgggctcggaaaagcgatggccattcgcttcggcaaggagcaggcaaaagtggttatcaactattatagtaataaacaagatccgaacgaggtaaaggaactggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgatcaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 530 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNEVKELVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTINAEKWADPKQKADVESMIPMGYIGEPEEIAAVAAWLASKEASYVTGITLFADGGMTLYPSFQAGRG

SEQ ID NO: 531 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcaccaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaacgtccactatgccgcaagtaaaggcgggatgaagctgatgacaaaaacattagcgttggaatacgcgccgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 532 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVTNPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTINAEKWADPKQKADVESMIPMGYIGEPEEIAAVAAWLASKEASYVTGITLFADGGMTLYPSFQAGRG

SEQ ID NO: 533 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttacaggtccactatgccgcaagtaaaggcgggatgaagctgatgacaaaaacattagcgttggaatacgcgccgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 534 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNEVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLQVHYAASKGGMKLMTKTLALEYAPKGIRVNNIGPGAINTTINAEKWADPKQKADVESMIPMGYIGEPEEIAAVAAWLASKEASYVTGITLFADGGMTLYPSFQAGRG

SEQ ID NO: 535 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgactgaagtgattccttggccgttacaggtccactatgccgcaagtaaaggcgggatgaagctgatgacaaaaacattagcgttggaatacgcgccgaagggcattcgcgtcaataatattgggccaggtgcgatcaacacgacgatcaatgctgagaagtgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgagtccttcattccaggcaggccgcggt

SEQ ID NO: 536 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVTEVIPWPLQVHYAASKGGMKLMTKTLALEYAPKGIRVNNIGPGAINTTINAEKWADPKQKADVESMIPMGYIGEPEEIAAVAAWLASKEASYVTGITLFADGGMTLSPSFQAGRG

SEQ ID NO: 537 - DNA, 783 bp, Artificial Sequence
  Variant of Glucose Dehydrogenase from Bacillus subtilis
atgtatccggatttaaaaggaaaagtcgtcgctattacaggagctgctactgggctcggacgcgcgatggccattcgcttcggcaaggagcaggcaaaagtggttatcaactattatagtaataaacaagatccgaacgaggtagccgaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggcggtggt

SEQ ID NO: 538 - protein, 261 aa, Artificial Sequence
  Variant of Glucose Dehydrogenase from Bacillus subtilis
MYPDLKGKVVAITGAATGLGRAMAIRFGKEQAKVVINYYSNKQDPNEVAEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTINAEKWADPKQKADVESMIPMGYIGEPEEIAAVAAWLASKEASYVTGITLFADGGMTLYPSFQAGGG

SEQ ID NO: 539 - DNA, 783 bp, Artificial Sequence
  Variant of Glucose Dehydrogenase from Bacillus subtilis
atgtatccggatttaaaaggaaaagtcgtcgctattacaggagctgctactgggctcggaaaagcgatggccattcgcttcggcaaggagcaggcaaaagtggttatcaactattatagtaataaacaagatccgaacgaggtagccgaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgatcaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 540 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNEVAEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTINAEKWADPKQKADVESMIPMGYIGEPEEIAAVAAWLASKEASYVTGITLFADGGMTLYPSFQAGRG

SEQ ID NO: 541 - DNA, 783 bp, Artificial Sequence
  Variant of Glucose Dehydrogenase from Bacillus subtilis
atgtatccggatttaaaaggaaaagtcgtcgctattacaggagctgctactgggctcggaaaagcgatggccattcgcttcggcaaggagcaggcaaaagtggttatcaactattatagtaataagcaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttacgcgtccactatgccgcaagtaaaggcgggatgaagctgatgacaaaaacattagcgttggaatacgcgccgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgctgccttcattccaggcaggccgtggt

SEQ ID NO: 542 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNEVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLRVHYAASKGGMKLMTKTLALEYAPKGIRVNNIGPGAINTTINAEKWADPKQKADVESMIPMGYIGEPEEIAAVAAWLASKEASYVTGITLFADGGMTLLPSFQAGRG

SEQ ID NO: 543 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggtacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgtcgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 544 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLNVHYAASKGGMKLMTKTLALEYASKGIRVNNIGPGAINTTINAEKWADPKQKADVESMIPMGYIGEPEEIAAVAAWLASKEASYVTGITLFADGGMTLYPSFQAGRG

SEQ ID NO: 545 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggtacgaacttaacgggtgcctttttaggaagccgtgaagcgattaaatatttcgtagaaaacgatatcaagggaaatgtcattaacatgtccagtgtgatcgaagtgattccttggccgttacgcgtccactatgccgcaagtaaaggcgggatgaagctgatgacaaaaacattagcgttggaatacgcgtcgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 546 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNEVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLRVHYAASKGGMKLMTKTLALEYASKGIRVNNIGPGAINTTINAEKWADPKQKADVESMIPMGYIGEPEEIAAVAAWLASKEASYVTGITLFADGGMTLYPSFQAGRG

SEQ ID NO: 547 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgcggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcaccaatcctgtgccatctcacgaaatgccgctcaaggattgggataaagtcatcggtacgaacttaacgggtgcctttttaggaagccgtgaagcgattaaatatttcgtagaaaacgatatcaagggaaatgtcattaacatgtccagtgtgatcgaagtgattccttggccgttacaggtccactatgccgcaagtaaaggcgggatgaagctgatgacaaaaacattagcgttggaatacgcgccgaagggcattcgcgtcaataatattgggccaggtgcgatcaacacgacgaacaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 548 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNAVKEEVIKAGGEAVVVQGDVTKEEDVKNIVQTAIKEFGTLDIMINNAGVTNPVPSHEMPLKDWDKVIGTNLTGAFLGSREAIKYFVENDIKGNVINMSSVIEVIPWPLQVHYAASKGGMKLMTKTLALEYAPKGIRVNNIGPGAINTTNNAERWADPKQKADVESMIPMGYIGEPEEIAAVAAWLASKEASYVTGITLFADGGMTLYPSFQAGRG

SEQ ID NO: 549 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcaattcaggcaggccgcggt

SEQ ID NO: 550 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTINAEKWADPKQKADVESMIPMGYIGEPEEIAAVAAWLASKEASYVTGITLFADGGMTLYPSIQAGRG

SEQ ID NO: 551 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgcaaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgactgaagtgattccttggccgttacgcgtccactatgccgcaagtaaaggcgggatgaagctgatgacaaaaacattagcgttggaatacgcgccgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 552 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNEVKEEVIKAGGEAVVVQGDVTKEEDVKNIVQTAIKEFGTLDIMINNAGVANPVPSHEMPLKDWDKVIGTNLTGAFLGSREAIKYFVENDIKGNVINMSSVTEVIPWPLRVHYAASKGGMKLMTKTLALEYAPKGIRVNNIGPGAINTTINAEKWADPKQKADVESMIPMGYIGEPEEIAAVAAWLASKEASYVTGITLFADGGMTLYPSFQAGRG

SEQ ID NO: 553 - DNA, 783 bp, Artificial Sequence
  Variant of Glucose Dehydrogenase from Bacillus subtilis
atgtatccggatttaaaaggaaaagtcgtcgctattacaggagctgctactgggctcggacgcgcgatggccattcgcttcggcaaggagcaggcaaaagtggttatcaactattatagtaataaacaagatccgaacgaggtagccgaactggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgatcaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggcggtggt

SEQ ID NO: 554 - protein, 261 aa, Artificial Sequence
  Variant of Glucose Dehydrogenase from Bacillus subtilis
MYPDLKGKVVAITGAATGLGRAMAIRFGKEQAKVVINYYSNKQDPNEVAELVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTINAEKWADPKQKADVESMIPMGYIGEPEEIAAVAAWLASKEASYVTGITLFADGGMTLYPSFQAGGG

SEQ ID NO: 555 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcggcgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 556 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLNVHYAASKGGMKLMTKTLALEYAAKGIRVNNIGPGAINTTINAEKWADPKQKADVESMIPMGYIGEPEEIAAVAAWLASKEASYVTGITLFADGGMTLYPSFQAGRG

SEQ ID NO: 557 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagacccgaacagtgtaaaagaagcggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgattgaagtgattccttggccgttaaacgtccactatgccgcaagtaaaggcgggatgaagctgatgacaaaaacattagcgttggaatacgcgccgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgagtccttcattccaggcaggccgcggt

SEQ ID NO: 558 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNSVKEAVIKAGGEAVVVQGDVTKEEDVKNIVQTAIKEFGTLDIMINNAGVENPVPSHEMPLKDWDKVIATNLTGAFLGSREAIKYFVENDIKGNVINMSSVIEVIPWPLNVHYAASKGGMKLMTKTLALEYAPKGIRVNNIGPGAINTTINAEKWADPKQKADVESMIPMGYIGEPEEIAAVAAWLASKEASYVTGITLFADGGMTLSPSFQAGRG

SEQ ID NO: 559 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcagatcgcggt

SEQ ID NO: 560 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTINAEKWADPKQKADVESMIPMGYIGEPEEIAAVAAWLASKEASYVTGITLFADGGMTLYPSFQADRG

SEQ ID NO: 561 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaggaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcagtaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttacgcgtccactatgccgcaagtaaaggcgggatgaagctgatgacaaaaacattagcgttggaatacgcgccgaagggcattcgcgtcaataatattgggccaggtgcgatcaacacgacgatcaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgctgccttcattccaggcaggccgcggt

SEQ ID NO: 562 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVSNPVPSHEMPLKDWDKVIGTNLTGAFLGSREAIKYFVENDIKGNVINMSSVIEVIPWPLRVHYAASKGGMKLMTKTLALEYAPKGIRVNNIGPGAINTTINAEKWADPKQKADVESMIPMGYIGEPEEIAAVAAWLASKEASYVTGITLFADGGMTLLPSFQAGRG

SEQ ID NO: 563 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggtacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 564 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNEVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTGNAERWADPKQKADVESMIPMGYIGEPEEIAAVAAWLASKEASYVTGITLFADGGMTLYPSFQAGRG

SEQ ID NO: 565 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagcggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgatcgaagtgattccttggccgttacaggtccactatgccgcaagtaaaggcgggatgaagctgatgacaaaaacattagcgttggaatacgcgccgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 566 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEAVIKAGGEAVVVQGDVTKEEDVKNIVQTAIKEFGTLDIMINNAGVENPVPSHEMPLKDWDKVIATNLTGAFLGSREAIKYFVENDIKGNVINMSSVIEVIPWPLQVHYAASKGGMKLMTKTLALEYAPKGIRVNNIGPGAINTTGNAERWADPKQKADVESMIPMGYIGEPEEIAAVAAWLASKEASYVTGITLFADGGMTLYPSFQAGRG

SEQ ID NO: 567 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgatcgaagtgattccttggccgttaaacgtccactatgccgcaagtaaaggcgggatgaagctgatgacaaaaacattagcgttggaatacgcgccgaagggcattcgcgtcaataatattgggccaggtgcgatcaacacgacgggtaatgctgagaagtgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 568 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVIEVIPWPLNVHYAASKGGMKLMTKTLALEYAPKGIRVNNIGPGAINTTGNAEKWADPKQKADVESMIPMGYIGEPEEIAAVAAWLASKEASYVTGITLFADGGMTLYPSFQAGRG

SEQ ID NO: 569 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacacagacattagcgttggaatacgcgccgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 570 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLNVHYAASKGGMKLMTQTLALEYAPKGIRVNNIGPGAINTTINAEKWADPKQKADVESMIPMGYIGEPEEIAAVAAWLASKEASYVTGITLFADGGMTLYPSFQAGRG

SEQ ID NO: 571 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtctgcaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttacgcgtccactatgccgcaagtaaaggcgggatgaagctgatgacaaaaacattagcgttggaatacgcgccgaagggcattcgcgtcaataatattgggccaggtgcgatcaacacgacgggtaatgctgagaagtgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 572 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVCNPVPSHEMPLKDWDKVIGTNLTGAFLGSREAIKYFVENDIKGNVINMSSVIEVIPWPLRVHYAASKGGMKLMTKTLALEYAPKGIRVNNIGPGAINTTGNAEKWADPKQKADVESMIPMGYIGEPEEIAAVAAWLASKEASYVTGITLFADGGMTLYPSFQAGRG

SEQ ID NO: 573 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagacccgtggctggtaaaagaagcggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgattgaagtgattccttggccgttacaggtccactatgccgcaagtaaaggcgggatgaagctgatgacaaaaacattagcgttggaatacgcgccgaagggcattcgcgtcaataatattgggccaggtgcgatcaacacgacgatcaatgctgagaagtgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 574 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPWLVKEAVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLQVHYAASKGGMKLMTKTLALEYAPKGIRVNNIGPGAINTTINAEKWADPKQKADVESMIPMGYIGEPEEIAAVAAWLASKEASYVTGITLFADGGMTLYPSFQAGRG

SEQ ID NO: 575 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcaccaatcctgtgccatctcacgaaatgccgctcaaggattgggataaagtcatcggtacgaacttaacgggtgcctttttaggaagccgtgaagcgattaaatatttcgtagaaaacgatatcaagggaaatgtcattaacatgtccagtgtgattgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgggtaatgctgagaagtgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 576 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVTNPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTGNAEKWADPKQKADVESMIPMGYIGEPEEIAAVAAWLASKEASYVTGITLFADGGMTLYPSFQAGRG

SEQ ID NO: 577 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagcggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttacaggtccactatgccgcaagtaaaggcgggatgaagctgatgacaaaaacattagcgttggaatacgcgccgaagggcattcgcgtcaataatattgggccaggtgcgatcaacacgacgaacaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 578 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEAVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLQVHYAASKGGMKLMTKTLALEYAPKGIRVNNIGPGAINTTNNAERWADPKQKADVESMIPMGYIGEPEEIAAVAAWLASKEASYVTGITLFADGGMTLYPSFQAGRG

SEQ ID NO: 579 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagacccgaacgcggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcaccaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttacaggtccactatgccgcaagtaaaggcgggatgaagctgatgacaaaaacattagcgttggaatacgcgtcgaagggcattcgcgtcaataatattgggccaggtgcgatcaacacgacgggtaatgctgagaagtgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 580 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNAVKEEVIKAGGEAVVVQGDVTKEEDVKNIVQTAIKEFGTLDIMINNAGVTNPVPSHEMPLKDWDKVIGTNLTGAFLGSREAIKYFVENDIKGNVINMSSVIEVIPWPLQVHYAASKGGMKLMTKTLALEYASKGIRVNNIGPGAINTTGNAEKWADPKQKADVESMIPMGYIGEPEEIAAVAAWLASKEASYVTGITLFADGGMTLYPSFQAGRG

SEQ ID NO: 581 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagacccgaacgaggtaaaagaagcggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgatcaatgctgagaagtgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgggtccttcattccaggcaggccgcggt

SEQ ID NO: 582 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEAVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTINAEKWADPKQKADVESMIPMGYIGEPEEIAAVAAWLASKEASYVTGITLFADGGMTLGPSFQAGRG

SEQ ID NO: 583 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcagagcgcggt

SEQ ID NO: 584 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTINAEKWADPKQKADVESMIPMGYIGEPEEIAAVAAWLASKEASYVTGITLFADGGMTLYPSFQAERG

SEQ ID NO: 585 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccggagaatgtccactatgccgcaagtaaaggcgggatgaagctgatgacaaaaacattagcgttggaatacgcgccgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 586 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPENVHYAASKGGMKLMTKTLALEYAPKGIRVNNIGPGAINTTINAEKWADPKQKADVESMIPMGYIGEPEEIAAVAAWLASKEASYVTGITLFADGGMTLYPSFQAGRG

SEQ ID NO: 587 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 588 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVIEVIPWPLNVHYAASKGGMKLMTKTLALEYAPKGIRVNNIGPGAINTTINAEKWADPKQKADVESMIPMGYIGEPEEIAAVAAWLASKEASYVTGITLFADGGMTLYPSFQAGRG

SEQ ID NO: 589 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgatcgaagtgattccttggccgttaaacgtccactatgccgcaagtaaaggcgggatgaagctgatgacaaaaacattagcgttggaatacgcgccgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgcgtccttcattccaggcaggccgcggt

SEQ ID NO: 590 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNEVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVIEVIPWPLNVHYAASKGGMKLMTKTLALEYAPKGIRVNNIGPGAINTTINAEKWADPKQKADVESMIPMGYIGEPEEIAAVAAWLASKEASYVTGITLFADGGMTLRPSFQAGRG

SEQ ID NO: 591 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagcggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaacgtccactatgccgcaagtaaaggcgggatgaagctgatgacaaaaacattagcgttggaatacgcgccgaagggcattcgcgtcaataatattgggccaggtgcgatcaacacgacgaacaatgctgagaagtgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 592 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEAVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTNNAEKWADPKQKADVESMIPMGYIGEPEEIAAVAAWLASKEASYVTGITLFADGGMTLYPSFQAGRG

SEQ ID NO: 593 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttacaggtccactatgccgcaagtaaaggcgggatgaagctgatgacaaaaacattagcgttggaatacgcgccgaagggcattcgcgtcaataatattgggccaggtgcgatcaacacgacgggtaatgctgagaagtgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgggtccttcattccaggcaggccgcggt

SEQ ID NO: 594 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLQVHYAASKGGMKLMTKTLALEYAPKGIRVNNIGPGAINTTGNAEKWADPKQKADVESMIPMGYIGEPEEIAAVAAWLASKEASYVTGITLFADGGMTLGPSFQAGRG

SEQ ID NO: 595 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttacaggtccactatgccgcaagtaaaggcgggatgaagctgatgacaaaaacattagcgttggaatacgcgccgaagggcattcgcgtcaataatattgggccaggtgcgatcaacacgacgaacaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 596 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLQVHYAASKGGMKLMTKTLALEYAPKGIRVNNIGPGAINTTNNAERWADPKQKADVESMIPMGYIGEPEEIAAVAAWLASKEASYVTGITLFADGGMTLYPSFQAGRG

SEQ ID NO: 597 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagcggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcagcaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttacaggtccactatgccgcaagtaaaggcgggatgaagctgatgacaaaaacattagcgttggaatacgcgccgaagggcattcgcgtcaataatattgggccaggtgcgatcaacacgacgggtaatgctgagaagtgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 598 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEAVIKAGGEAVVVQGDVTKEEDVKNIVQTAIKEFGTLDIMINNAGVSNPVPSHEMPLKDWDKVIGTNLTGAFLGSREAIKYFVENDIKGNVINMSSVIEVIPWPLQVHYAASKGGMKLMTKTLALEYAPKGIRVNNIGPGAINTTGNAEKWADPKQKADVESMIPMGYIGEPEEIAAVAAWLASKEASYVTGITLFADGGMTLYPSFQAGRG

SEQ ID NO: 599 - DNA, 783 bp, Artificial Sequence
  Variant of Glucose Dehydrogenase from Bacillus subtilis
atgtatccggatttaaaaggaaaagtcgtcgctattacaggagctgctagcgggctcggaaaggcgatggccattcgcttcggcaaggagcaggcaaaagtggttatcaactattatagtaataaacaagacccgaacagtgtaaaagaagcggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcggtacgaacttaacgggtgcctttttaggaagccgtgaagcgattaaatatttcgtagaaaacgatatcaagggaaatgtcattaacatgtccagtgtgattgaagtgattccttggccgttacgcgtccactatgccgcaagtaaaggcgggatgaagctgatgacaaaaacattagcgttggaatacgcgtcgaagggcattcgcgtcaataatattgggccaggtgcgatcaacacgacgaacaatgctgagaagtgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 600 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNSVKEAVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLRVHYAASKGGMKLMTKTLALEYASKGIRVNNIGPGAINTTNNAEKWADPKQKADVESMIPMGYIGEPEEIAAVAAWLASKEASYVTGITLFADGGMTLYPSFQAGRG

SEQ ID NO: 601 - DNA, 783 bp, Artificial Sequence
  Variant of Glucose Dehydrogenase from Bacillus subtilis
atgtatccggatttaaaaggaaaagtcgtcgctattacaggagctgctactgggctcggaaaagcgatggccattcgcttcggcaaggagcaggcaaaagtggttatcaactattatagtaataaacaagatccgaacgaggtagccgaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggcggtggt

SEQ ID NO: 602 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNEVAEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTINAEKWADPKQKADVESMIPMGYIGEPEEIAAVAAWLASKEASYVTGITLFADGGMTLYPSFQAGGG

SEQ ID NO: 603 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttacaggtccactatgccgcaagtaaaggcgggatgaagctgatgacaaaaacattagcgttggaatacgcgccgaagggcattcgcgtcaataatattgggccaggtgcgatcaacacgacgatcaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 604 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNEVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLQVHYAASKGGMKLMTKTLALEYAPKGIRVNNIGPGAINTTINAERWADPKQKADVESMIPMGYIGEPEEIAAVAAWLASKEASYVTGITLFADGGMTLYPSFQAGRG

SEQ ID NO: 605 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaaggggatgacaaaaacattagcgttggaatacgcgccgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 606 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLNVHYAASKGGMKGMTKTLALEYAPKGIRVNNIGPGAINTTINAEKWADPKQKADVESMIPMGYIGEPEEIAAVAAWLASKEASYVTGITLFADGGMTLYPSFQAGRG

SEQ ID NO: 607 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaagcgatggccattcgcttcggcaaggagcaggcaaaagtggttatcaactattatagtaataaacaagatccgaacgaggtaaaggaactggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgaacaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 608 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKELVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTNNAEKWADPKQKADVESMIPMGYIGEPEEIAAVAAWLASKEASYVTGITLFADGGMTLYPSFQAGRG

SEQ ID NO: 609 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattcgaggcaggccgcggt

SEQ ID NO: 610 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTINAEKWADPKQKADVESMIPMGYIGEPEEIAAVAAWLASKEASYVTGITLFADGGMTLYPSFEAGRG

SEQ ID NO: 611 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgggtaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 612 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLNVHYAASKGGMKLMTKTLALEYAGKGIRVNNIGPGAINTTINAEKWADPKQKADVESMIPMGYIGEPEEIAAVAAWLASKEASYVTGITLFADGGMTLYPSFQAGRG

SEQ ID NO: 613 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgatcaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 614 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNEVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTINAERWADPKQKADVESMIPMGYIGEPEEIAAVAAWLASKEASYVTGITLFADGGMTLYPSFQAGRG

SEQ ID NO: 615 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcaccaatcctgtgccatctcacgaaatgccgctcaaggattgggataaagtcatcggtacgaacttaacgggtgcctttttaggaagccgtgaagcgattaaatatttcgtagaaaacgatatcaagggaaatgtcattaacatgtccagtgtgactgaagtgattccttggccgttaaacgtccactatgccgcaagtaaaggcgggatgaagctgatgacaaaaacattagcgttggaatacgcgtcgaagggcattcgcgtcaataatattgggccaggtgcgatcaacacgacgaacaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 616 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVTNPVPSHEMPLKDWDKVIGTNLTGAFLGSREAIKYFVENDIKGNVINMSSVTEVIPWPLNVHYAASKGGMKLMTKTLALEYASKGIRVNNIGPGAINTTNNAERWADPKQKADVESMIPMGYIGEPEEIAAVAAWLASKEASYVTGITLFADGGMTLYPSFQAGRG

SEQ ID NO: 617 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaaaacccgaacagtgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgactgaagtgattccttggccgttacaggtccactatgccgcaagtaaaggcgggatgaagctgatgacaaaaacattagcgttggaatacgcgccgaagggcattcgcgtcaataatattgggccaggtgcgatcaacacgacgatcaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 618 - protein, 261 aa, Artificial Sequence
  Variant of Glucose Dehydrogenase from Bacillus subtilis
MYPDLKGKVVAITGAASGLGKAMAIRFGKEQAKVVINYYSNKQNPNSVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVTEVIPWPLQVHYAASKGGMKLMTKTLALEYAPKGIRVNNIGPGAINTTINAERWADPKQKADVESMIPMGYIGEPEEIAAVAAWLASKEASYVTGITLFADGGMTLYPSFQAGRG

SEQ ID NO: 619 - DNA, 783 bp, Artificial Sequence
  Variant of Glucose Dehydrogenase from Bacillus subtilis
atgtatccggatttaaaaggaaaagtcgtcgctattacaggagctgctactgggctcggacgcgcgatggccattcgcttcggcaaggagcaggcaaaagtggttatcaactattatagtaataaacaagatccgaacgaggtaaaggaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgctgccttcattccaggcaggccgcggt

SEQ ID NO: 620 - protein, 261 aa, Artificial Sequence
  Variant of Glucose Dehydrogenase from Bacillus subtilis
MYPDLKGKVVAITGAATGLGRAMAIRFGKEQAKVVINYYSNKQDPNEVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTINAEKWADPKQKADVESMIPMGYIGEPEEIAAVAAWLASKEASYVTGITLFADGGMTLLPSFQAGRG

SEQ ID NO: 621 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaacgtccactatgccgcaagtaaaggcgggatgaagctgatgacaaaaacattagcgttggaatacgcgccgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgagtccttcattccaggcaggccgcggt

SEQ ID NO: 622 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNEVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTGNAERWADPKQKADVESMIPMGYIGEPEEIAAVAAWLASKEASYVTGITLFADGGMTLSPSFQAGRG

SEQ ID NO: 623 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgactgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgatcaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 624 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNEVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVTEVIPWPLNVHYAASKGGMKLMTKTLALEYAPKGIRVNNIGPGAINTTINAERWADPKQKADVESMIPMGYIGEPEEIAAVAAWLASKEASYVTGITLFADGGMTLYPSFQAGRG

SEQ ID NO: 625 - DNA, 783 bp, Artificial Sequence
  Variant of Glucose Dehydrogenase from Bacillus subtilis
atgtatccggatttaaaaggaaaagtcgtcgctattacaggagctgctagcgggctcggaaaggcgatggccattcgcttcggcaaggagcaggcaaaagtggttatcaactattatagtaataaacaagacccgtgggcggtaaaagaagcggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggtacgaacttaacgggtgcctttttaggaagccgtgaagcgattaaatatttcgtagaaaacgatatcaagggaaatgtcattaacatgtccagtgtgattgaagtgattccttggccgttacgcgtccactatgccgcaagtaaaggcgggatgaagctgatgacaaaaacattagcgttggaatacgcgccgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 626 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPWAVKEAVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLRVHYAASKGGMKLMTKTLALEYAPKGIRVNNIGPGAINTTGNAERWADPKQKADVESMIPMGYIGEPEEIAAVAAWLASKEASYVTGITLFADGGMTLYPSFQAGRG

SEQ ID NO: 627 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 628 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNEVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTINAEKWADPKQKADVESMIPMGYIGEPEEIAAVAAWLASKEASYVTGITLFADGGMTLYPSFQAGRG

SEQ ID NO: 629 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagacccgaacctggtaaaagaagcggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgattgaagtgattccttggccgttacaggtccactatgccgcaagtaaaggcgggatgaagctgatgacaaaaacattagcgttggaatacgcgccgaagggcattcgcgtcaataatattgggccaggtgcgatcaacacgacgggtaatgctgagaagtgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgagtccttcattccaggcaggccgcggt

SEQ ID NO: 630 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNLVKEAVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLQVHYAASKGGMKLMTKTLALEYAPKGIRVNNIGPGAINTTGNAEKWADPKQKADVESMIPMGYIGEPEEIAAVAAWLASKEASYVTGITLFADGGMTLSPSFQAGRG

SEQ ID NO: 631 - DNA, 783 bp, Artificial Sequence
  Variant of Glucose Dehydrogenase from Bacillus subtilis
atgtatccggatttaaaaggaaaagtcgtcgctattacaggagctgctactgggctcggaaaagcgatggccattcgcttcggcaaggagcaggcaaaagtggttatcaactattatagtaataaacaagatccgaacgaggtagccgaactggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttacgcgtccactatgccgcaagtaaaggcgggatgaagctgatgacaaaaacattagcgttggaatacgcgccgaagggcattcgcgtcaataatattgggccaggtgcgatcaacacgacgatcaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggcggtggt

SEQ ID NO: 632 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNEVAELVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLRVHYAASKGGMKLMTKTLALEYAPKGIRVNNIGPGAINTTINAEKWADPKQKADVESMIPMGYIGEPEEIAAVAAWLASKEASYVTGITLFADGGMTLYPSFQAGGG

SEQ ID NO: 633 - DNA, 783 bp, Artificial Sequence
  Variant of Glucose Dehydrogenase from Bacillus subtilis
atgtatccggatttaaaaggaaaagtcgtcgctattacaggagctgctactgggctcggaaaagcgatggccattcgcttcggcaaggagcaggcaaaagtggttatcaactattatagtaataaacaagatccgaacgaggtagccgaactggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgatcaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgctgccttcattccaggcaggccgcggt

SEQ ID NO: 634 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNEVAELVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTINAEKWADPKQKADVESMIPMGYIGEPEEIAAVAAWLASKEASYVTGITLFADGGMTLLPSFQAGRG

SEQ ID NO: 635 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatggctctgtatccttcattccaggcaggccgcggt

SEQ ID NO: 636 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTINAEKWADPKQKADVESMIPMGYIGEPEEIAAVAAWLASKEASYVTGITLFADGGMALYPSFQAGRG

SEQ ID NO: 637 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagacccgtggctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcggtacgaacttaacgggtgcctttttaggaagccgtgaagcgattaaatatttcgtagaaaacgatatcaagggaaatgtcattaacatgtccagtgtgattgaagtgattccttggccgttacgcgtccactatgccgcaagtaaaggcgggatgaagctgatgacaaaaacattagcgttggaatacgcgccgaagggcattcgcgtcaataatattgggccaggtgcgatcaacacgacgaacaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 638 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPWLVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLRVHYAASKGGMKLMTKTLALEYAPKGIRVNNIGPGAINTTNNAERWADPKQKADVESMIPMGYIGEPEEIAAVAAWLASKEASYVTGITLFADGGMTLYPSFQAGRG

SEQ ID NO: 639 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgctgctgtatccttcattccaggcaggccgcggt

SEQ ID NO: 640 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTINAEKWADPKQKADVESMIPMGYIGEPEEIAAVAAWLASKEASYVTGITLFADGGMLLYPSFQAGRG

SEQ ID NO: 641 - DNA, 783 bp, Artificial Sequence
  Variant of Glucose Dehydrogenase from Bacillus subtilis
atgtatccggatttaaaaggaaaagtcgtcgctattacaggagctgctactgggctcggaaaagcgatggccattcgcttcggcaaggagcaggcaaaagtggttatcaactattatagtaataaacaagatccgaacgaggtaaaggaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggcggtggt

SEQ ID NO: 642 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNEVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTINAEKWADPKQKADVESMIPMGYIGEPEEIAAVAAWLASKEASYVTGITLFADGGMTLYPSFQAGGG

SEQ ID NO: 643 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagatattccttggccgttaaatgtccactatgccgcaagtaaaggcgggatgaagctgatgacaaaaacattagcgttggaatacgcgccgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 644 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEDIPWPLNVHYAASKGGMKLMTKTLALEYAPKGIRVNNIGPGAINTTINAEKWADPKQKADVESMIPMGYIGEPEEIAAVAAWLASKEASYVTGITLFADGGMTLYPSFQAGRG

SEQ ID NO: 645 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgattaatgctcataaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 646 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTINAHKWADPKQKADVESMIPMGYIGEPEEIAAVAAWLASKEASYVTGITLFADGGMTLYPSFQAGRG

SEQ ID NO: 647 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagacccgtgggaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgagtccttcattccaggcaggccgcggt

SEQ ID NO: 648 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPWEVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVIEVIPWPLNVHYAASKGGMKLMTKTLALEYAPKGIRVNNIGPGAINTTGNAERWADPKQKADVESMIPMGYIGEPEEIAAVAAWLASKEASYVTGITLFADGGMTLSPSFQAGRG

SEQ ID NO: 649 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggcgagggt

SEQ ID NO: 650 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTINAEKWADPKQKADVESMIPMGYIGEPEEIAAVAAWLASKEASYVTGITLFADGGMTLYPSFQAGEG

SEQ ID NO: 651 - DNA, 783 bp, Artificial Sequence
  Variant of Glucose Dehydrogenase from Bacillus subtilis
atgtatccggatttaaaaggaaaagtcgtcgctattacaggagctgctactgggctcggaaaagcgatggccattcgcttcggcaaggagcaggcaaaagtggttatcaactattatagtaataaacaagatccgaacgaggtaaaggaactggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgatcaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgctgccttcattccaggcaggccgcggt

SEQ ID NO: 652 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNEVKELVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTINAEKWADPKQKADVESMIPMGYIGEPEEIAAVAAWLASKEASYVTGITLFADGGMTLLPSFQAGRG

SEQ ID NO: 653 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagacccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgatcgaagtgattccttggccgttacgcgtccactatgccgcaagtaaaggcgggatgaagctgatgacaaaaacattagcgttggaatacgcgccgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 654 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNLVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVIEVIPWPLRVHYAASKGGMKLMTKTLALEYAPKGIRVNNIGPGAINTTGNAERWADPKQKADVESMIPMGYIGEPEEIAAVAAWLASKEASYVTGITLFADGGMTLYPSFQAGRG

SEQ ID NO: 655 - DNA, 783 bp, Artificial Sequence
  Variant of Glucose Dehydrogenase from Bacillus subtilis
atgtatccggatttaaaaggaaaagtcgtcgctattacaggagctgctactgggctcggaaaagcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgctgccttcattccaggcaggccgcggt

SEQ ID NO: 656 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNEVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTINAEKWADPKQKADVESMIPMGYIGEPEEIAAVAAWLASKEASYVTGITLFADGGMTLLPSFQAGRG

SEQ ID NO: 657 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagcggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgggtaatgctgagaagtgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 658 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEAVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTGNAEKWADPKQKADVESMIPMGYIGEPEEIAAVAAWLASKEASYVTGITLFADGGMTLYPSFQAGRG

SEQ ID NO: 659 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgggtaatgctgagaagtgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 660 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTGNAEKWADPKQKADVESMIPMGYIGEPEEIAAVAAWLASKEASYVTGITLFADGGMTLYPSFQAGRG

SEQ ID NO: 661 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagacccgaacagtgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcagcaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttacgcgtccactatgccgcaagtaaaggcgggatgaagctgatgacaaaaacattagcgttggaatacgcgccgaagggcattcgcgtcaataatattgggccaggtgcgatcaacacgacgggtaatgctgagaagtgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 662 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNSVKEEVIKAGGEAVVVQGDVTKEEDVKNIVQTAIKEFGTLDIMINNAGVSNPVPSHEMPLKDWDKVIGTNLTGAFLGSREAIKYFVENDIKGNVINMSSVIEVIPWPLRVHYAASKGGMKLMTKTLALEYAPKGIRVNNIGPGAINTTGNAEKWADPKQKADVESMIPMGYIGEPEEIAAVAAWLASKEASYVTGITLFADGGMTLYPSFQAGRG

SEQ ID NO: 663 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgattaatgctgagaaatgggctgaccctaaacagaaagctgatgtagaaagcatgattggtatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 664 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTINAEKWADPKQKADVESMIGMGYIGEPEEIAAVAAWLASKEASYVTGITLFADGGMTLYPSFQAGRG

SEQ ID NO: 665 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcctggaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 666 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVENPVPSHEMPLKDWDKVIGTNLTGAFLGSREAIKYFLENDIKGNVINMSSVIEVIPWPLNVHYAASKGGMKLMTKTLALEYAPKGIRVNNIGPGAINTTINAEKWADPKQKADVESMIPMGYIGEPEEIAAVAAWLASKEASYVTGITLFADGGMTLYPSFQAGRG

SEQ ID NO: 667 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgattggggctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 668 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTIGAEKWADPKQKADVESMIPMGYIGEPEEIAAVAAWLASKEASYVTGITLFADGGMTLYPSFQAGRG

SEQ ID NO: 669 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttacgcgtccactatgccgcaagtaaaggcgggatgaagctgatgacaaaaacattagcgttggaatacgcgccgaagggcattcgcgtcaataatattgggccaggtgcgatcaacacgacgaacaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgctgccttcattccaggcaggccgtggt

SEQ ID NO: 670 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLRVHYAASKGGMKLMTKTLALEYAPKGIRVNNIGPGAINTTNNAEKWADPKQKADVESMIPMGYIGEPEEIAAVAAWLASKEASYVTGITLFADGGMTLLPSFQAGRG

SEQ ID NO: 671 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattctgggcaggccgcggt

SEQ ID NO: 672 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTINAEKWADPKQKADVESMIPMGYIGEPEEIAAVAAWLASKEASYVTGITLFADGGMTLYPSFWAGRG

SEQ ID NO: 673 - DNA, 783 bp, Artificial Sequence
  Variant of Glucose Dehydrogenase from Bacillus subtilis
atgtatccggatttaaaaggaaaagtcgtcgctattacaggagctgctagtgggctcggacgcgcgatggccattcgcttcggcaaggagcaggcaaaagtggttatcaactattatagtaataaacaagatccgaacgaggtaaaggaactggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcagtaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttacgcgtccactatgccgcaagtaaaggcgggatgaagctgatgacaaaaacattagcgttggaatacgcgccgaagggcattcgcgtcaataatattgggccaggtgcgatcaacacgacgatcaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 674 - protein, 261 aa, Artificial Sequence
  Variant of Glucose Dehydrogenase from Bacillus subtilis
MYPDLKGKVVAITGAASGLGRAMAIRFGKEQAKVVINYYSNKQDPNEVKELVIKAGGEAVVVQGDVTKEEDVKNIVQTAIKEFGTLDIMINNAGVSNPVPSHEMPLKDWDKVIGTNLTGAFLGSREAIKYFVENDIKGNVINMSSVIEVIPWPLRVHYAASKGGMKLMTKTLALEYAPKGIRVNNIGPGAINTTINAEKWADPKQKADVESMIPMGYIGEPEEIAAVAAWLASKEASYVTGITLFADGGMTLYPSFQAGRG

SEQ ID NO: 675 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgattgaagtgattccttggccgttacgcgtccactatgccgcaagtaaaggcgggatgaagctgatgacaaaaacattagcgttggaatacgcgccgaagggcattcgcgtcaataatattgggccaggtgcgatcaacacgacgggtaatgctgagaagtgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 676 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNEVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLRVHYAASKGGMKLMTKTLALEYAPKGIRVNNIGPGAINTTGNAEKWADPKQKADVESMIPMGYIGEPEEIAAVAAWLASKEASYVTGITLFADGGMTLYPSFQAGRG

SEQ ID NO: 677 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacagcttatccttcattccaggcaggccgcggt

SEQ ID NO: 678 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTINAEKWADPKQKADVESMIPMGYIGEPEEIAAVAAWLASKEASYVTGITLFADGGMTAYPSFQAGRG

SEQ ID NO: 679 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgaagaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 680 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLNVHYAASKGGMKLMTKTLALEYAKKGIRVNNIGPGAINTTINAEKWADPKQKADVESMIPMGYIGEPEEIAAVAAWLASKEASYVTGITLFADGGMTLYPSFQAGRG

SEQ ID NO: 681 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgattaatgctgagaaatgggctgaccctaaacagaaagctgatgtagaaagcatgattccaatgggatatcctggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 682 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTINAEKWADPKQKADVESMIPMGYPGEPEEIAAVAAWLASKEASYVTGITLFADGGMTLYPSFQAGRG

SEQ ID NO: 683 - DNA, 783 bp, Artificial Sequence
  Variant of Glucose Dehydrogenase from Bacillus subtilis
atgtatccggatttaaaaggaaaagtcgtcgctattacaggagctgctagtgggctcggacgcgcgatggccattcgcttcggcaaggagcaggcaaaagtggttatcaactattatagtaataaacaagatccgaacgaggtagccgaactggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgatcaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 684 - protein, 261 aa, Artificial Sequence
  Variant of Glucose Dehydrogenase from Bacillus subtilis
MYPDLKGKVVAITGAASGLGRAMAIRFGKEQAKVVINYYSNKQDPNEVAELVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTINAEKWADPKQKADVESMIPMGYIGEPEEIAAVAAWLASKEASYVTGITLFADGGMTLYPSFQAGRG

SEQ ID NO: 685 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgattcatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 686 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTIHAEKWADPKQKADVESMIPMGYIGEPEEIAAVAAWLASKEASYVTGITLFADGGMTLYPSFQAGRG

SEQ ID NO: 687 - DNA, 783 bp, Artificial Sequence
  Variant of Glucose Dehydrogenase from Bacillus subtilis
atgtatccggatttaaaaggaaaagtcgtcgctattacaggagctgctagcgggctcggaaaggcgatggccattcgcttcggcaaggagcaggcaaaagtggttatcaactattatagtaataaacaagacccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgattgaagtgattccttggccgttaaacgtccactatgccgcaagtaaaggcgggatgaagctgatgacaaaaacattagcgttggaatacgcgccgaagggcattcgcgtcaataatattgggccaggtgcgatcaacacgacgaacaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 688 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNLVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTNNAERWADPKQKADVESMIPMGYIGEPEEIAAVAAWLASKEASYVTGITLFADGGMTLYPSFQAGRG

SEQ ID NO: 689 - DNA, 783 bp, Artificial Sequence
  Variant of Glucose Dehydrogenase from Bacillus subtilis
atgtatccggatttaaaaggaaaagtcgtcgctattacaggagctgctactgggctcggaaaagcgatggccattcgcttcggcaaggagcaggcaaaagtggttatcaactattatagtaataaacaagatccgaacgaggtagccgaactggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttacgcgtccactatgccgcaagtaaaggcgggatgaagctgatgacaaaaacattagcgttggaatacgcgccgaagggcattcgcgtcaataatattgggccaggtgcgatcaacacgacgatcaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgctgccttcattccaggcaggcggtggt

SEQ ID NO: 690 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNEVAELVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLRVHYAASKGGMKLMTKTLALEYAPKGIRVNNIGPGAINTTINAEKWADPKQKADVESMIPMGYIGEPEEIAAVAAWLASKEASYVTGITLFADGGMTLLPSFQAGGG

SEQ ID NO: 691 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcggtacgaacttaacgggtgcctttttaggaagccgtgaagcgattaaatatttcgtagaaaacgatatcaagggaaatgtcattaacatgtccagtgtgattgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgaacaatgctgagaagtgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 692 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTNNAEKWADPKQKADVESMIPMGYIGEPEEIAAVAAWLASKEASYVTGITLFADGGMTLYPSFQAGRG

SEQ ID NO: 693 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaacgtccactatgccgcaagtaaaggcgggatgaagctgatgacaaaaacattagcgttggaatacgcgtcgaagggcattcgcgtcaataatattgggccaggtgcgatcaacacgacgatcaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 694 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLNVHYAASKGGMKLMTKTLALEYASKGIRVNNIGPGAINTTINAERWADPKQKADVESMIPMGYIGEPEEIAAVAAWLASKEASYVTGITLFADGGMTLYPSFQAGRG

SEQ ID NO: 695 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacgaggtaaaagaagcggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttacgcgtccactatgccgcaagtaaaggcgggatgaagctgatgacaaaaacattagcgttggaatacgcgccgaagggcattcgcgtcaataatattgggccaggtgcgatcaacacgacgggtaatgctgagaagtgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 696 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNEVKEAVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLRVHYAASKGGMKLMTKTLALEYAPKGIRVNNIGPGAINTTGNAEKWADPKQKADVESMIPMGYIGEPEEIAAVAAWLASKEASYVTGITLFADGGMTLYPSFQAGRG

SEQ ID NO: 697 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgtctaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 698 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTSNAEKWADPKQKADVESMIPMGYIGEPEEIAAVAAWLASKEASYVTGITLFADGGMTLYPSFQAGRG

SEQ ID NO: 699 - DNA, 783 bp, Artificial Sequence
  Variant of Glucose Dehydrogenase from Bacillus subtilis
atgtatccggatttaaaaggaaaagtcgtcgctattacaggagctgctactgggctcggaaaagcgatggccattcgcttcggcaaggagcaggcaaaagtggttatcaactattatagtaataaacaagatccgaacgaggtaaaggaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttacgcgtccactatgccgcaagtaaaggcgggatgaagctgatgacaaaaacattagcgttggaatacgcgccgaagggcattcgcgtcaataatattgggccaggtgcgatcaacacgacgattaatgctgagaaatgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 700 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNEVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLRVHYAASKGGMKLMTKTLALEYAPKGIRVNNIGPGAINTTINAEKWADPKQKADVESMIPMGYIGEPEEIAAVAAWLASKEASYVTGITLFADGGMTLYPSFQAGRG

SEQ ID NO: 701 - DNA, 783 bp, Artificial Sequence
  Variant of Glucose Dehydrogenase from Bacillus subtilis
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcaccaatcctgtgccatctcacgaaatgccgctcaaggattgggataaagtcatcggtacgaacttaacgggtgcctttttaggaagccgtgaagcgattaaatatttcgtagaaaacgatatcaagggaaatgtcattaacatgtccagtgtgattgaagtgattccttggccgttacaggtccactatgccgcaagtaaaggcgggatgaagctgatgacaaaaacattagcgttggaatacgcgccgaagggcattcgcgtcaataatattgggccaggtgcgatcaacacgacgatcaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 702 - protein, 261 aa, Artificial Sequence
  Variant of Glucose Dehydrogenase from Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGVTNPVPSHEMPLKDWDKVIGTNLTGAFLGSREAIKYFVENDIKGNVINMSSVIEVIPWPLQVHYAASKGGMKLMTKTLALEYAPKGIRVNNIGPGAINTTINAERWADPKQKADVESMIPMGYIGEPEEIAAVAAWLASKEASYVTGITLFADGGMTLYPSFQAGRG

SEQ ID NO: 703 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcgccacgaacttaacgggtgcctttttaggaagccgtgaagcgattaaatatttcgtagaaaacgatatcaagggaaatgtcattaacatgtccagtgtgatcgaagacattccttggccgttacgcgtccactatgccgcaagtaaaggcgggatgaagctgatgacaaaaacattagcgttggaatacgcgccgaagggcattcgcgtcaataatattgggccaggtgcgatcaacacgacgggtaacgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgagcccttcattcgaggcaggccgcggt

SEQ ID NO: 704 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNLVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVIEDIPWPLRVHYAASKGGMKLMTKTLALEYAPKGIRVNNIGPGAINTTGNAERWADPKQKADVESMIPMGYIGEPEEIAAVAAWLASKEASYVTGITLFADGGMTLSPSFEAGRG

SEQ ID NO: 705 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtctgtaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgatcgaagtgattccttggccgttaaacgtccactatgccgcaagtaaaggcgggatgaagctgatgacaaaaacattagcgttggaatacgcgccgaagggcattcgcgtcaataatattgggccaggtgcgatcaacacgacgggtggtgctgagcgctgggctgaccctaaacagaaagctgatgtagaaagcatgattccgatgggatatattggcgaaccggaggagatcgccgcagtagcagcctggcttgcttcgaaggaagccagctacgtcacaggcatcacgttattcgcggacggcggtatgacaaccggcccttcattccaggcaggccgcggt

SEQ ID NO: 706 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNLVKEEVIKAGGEAVVVQGDVTKEEDVKNIVQTAIKEFGTLDIMINNAGVCNPVPSHEMPLKDWDKVIATNLTGAFLGSREAIKYFVENDIKGNVINMSSVIEVIPWPLNVHYAASKGGMKLMTKTLALEYAPKGIRVNNIGPGAINTTGGAERWADPKQKADVESMIPMGYIGEPEEIAAVAAWLASKEASYVTGITLFADGGMTTGPSFQAGRG

SEQ ID NO: 707 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtctgtaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgattgaagaaattccttggccgttacgcgtccactatgccgcaagtaaaggcgggatgaagctgatgacaaaaacattagcgttggaatacgcgccgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgactctgggtccttcaattcaggcaggccgcggt

SEQ ID NO: 708 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNLVKEEVIKAGGEAVVVQGDVTKEEDVKNIVQTAIKEFGTLDIMINNAGVCNPVPSHEMPLKDWDKVIATNLTGAFLGSREAIKYFVENDIKGNVINMSSVIEEIPWPLRVHYAASKGGMKLMTKTLALEYAPKGIRVNNIGPGAINTTGNAERWADPKQKADVESMIPMGYIGEPEEIAAVAAWLASKEASYVTGITLFADGGMTLGPSIQAGRG

SEQ ID NO: 709 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcagtaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgatcgaagtgattccttggccgttacgcgtccactatgccgcaagtaaaggcgggatgaagctgatgacaaaaacattagcgttggaatacgcgccgaagggcattcgcgtcaataatattgggccaggtgcgatcaacacgacgggtaatgctgagcgctgggctgaccctaaacagaaagctgatgtagaaagcatgattccgatgggatatattggcgaaccggaggagatcgccgcagtagcagcctggcttgcttcgaaggaagccagctacgtcacaggcatcacgttattcgcggacggcggtatgacactgagcccttcaatcgaggcaggccgcggt

SEQ ID NO: 710 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNLVKEEVIKAGGEAVVVQGDVTKEEDVKNIVQTAIKEFGTLDIMINNAGVSNPVPSHEMPLKDWDKVIATNLTGAFLGSREAIKYFVENDIKGNVINMSSVIEVIPWPLRVHYAASKGGMKLMTKTLALEYAPKGIRVNNIGPGAINTTGNAERWADPKQKADVESMIPMGYIGEPEEIAAVAAWLASKEASYVTGITLFADGGMTLSPSIEAGRG

SEQ ID NO: 711 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaataagcaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtctgtaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgattgaagaaattccttggccgttaaacgtccactatgccgcaagtaaaggcgggatgaagctgatgacaaaaacattagcgttggaatacgcgccgaagggcattcgcgtcaataatattgggccaggtgcgatcaacacgacgcgtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgagtccttcattccaggcaggccgcggt

SEQ ID NO: 712 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNLVKEEVIKAGGEAVVVQGDVTKEEDVKNIVQTAIKEFGTLDIMINNAGVCNPVPSHEMPLKDWDKVIATNLTGAFLGSREAIKYFVENDIKGNVINMSSVIEEIPWPLNVHYAASKGGMKLMTKTLALEYAPKGIRVNNIGPGAINTTRNAERWADPKQKADVESMIPMGYIGEPEEIAAVAAWLASKEASYVTGITLFADGGMTLSPSFQAGRG

SEQ ID NO: 713 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgatcgaagtgattccttggccgttacgcgtccactatgccgcaagtaaaggcgggatgaagcagatgacaaaaacattagcgttggaatacgcgccgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgagtccttcattccaggcaggccgcggt

SEQ ID NO: 714 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNLVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVIEVIPWPLRVHYAASKGGMKQMTKTLALEYAPKGIRVNNIGPGAINTTGNAERWADPKQKADVESMIPMGYIGEPEEIAAVAAWLASKEASYVTGITLFADGGMTLSPSFQAGRG

SEQ ID NO: 715 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgatcgaagtgattccttggccgttaaacgtccactatgccgcaagtaaaggcgggatgaagcagatgacaaaaacattagcgttggaatacgcgccgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgagtccttcattccaggcaggccgcggt

SEQ ID NO: 716 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNLVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVIEVIPWPLNVHYAASKGGMKQMTKTLALEYAPKGIRVNNIGPGAINTTGNAERWADPKQKADVESMIPMGYIGEPEEIAAVAAWLASKEASYVTGITLFADGGMTLSPSFQAGRG

SEQ ID NO: 717 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgatcgaagtaattccttggccgttacgcgtccactatgccgcaagtaaaggcgggatgaagcagatgacaaaaacattagcgttggaatacgcgccgaagggcattcgcgtcaataatattgggccaggtgcgatcaacacgacgaataatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgagtccttcattccaggcaggccgcggt

SEQ ID NO: 718 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNLVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVIEVIPWPLRVHYAASKGGMKQMTKTLALEYAPKGIRVNNIGPGAINTTNNAERWADPKQKADVESMIPMGYIGEPEEIAAVAAWLASKEASYVTGITLFADGGMTLSPSFQAGRG

SEQ ID NO: 719 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgatcgaagtgattccttggccgttacgcgtccactatgccgcaagtaaaggcgggatgaagctgatgacaaaaacattagcgttggaatacgcgccgaagggcattcgcgtcaataatattgggccaggtgcgatcaacacgacgggtaatgctgagcgctgggctgaccctaaacagaaagctgatgtagaaagcatgattggtatgggatatattggcgaaccggaggagatcgccgcagtagcagcctggcttgcttcgaaggaagccagctacgtcacaggcatcacgttattcgcggacggcggtatgacactgggcccttcaatccaggcaggccgcggt

SEQ ID NO: 720 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNLVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVIEVIPWPLRVHYAASKGGMKLMTKTLALEYAPKGIRVNNIGPGAINTTGNAERWADPKQKADVESMIGMGYIGEPEEIAAVAAWLASKEASYVTGITLFADGGMTLGPSIQAGRG

SEQ ID NO: 721 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcagtaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttacgcgtccactatgccgcaagtaaaggcgggatgaagctgatgacaaaaacattagcgttggaatacgcgccgaagggcattcgcgtcaataatattgggccaggtgcgatcaacacgacgggtaacgctgagcgctgggctgaccctaaacagaaagctgatgtagaaagcatgattggtatgggatatattggcgaaccggaggagatcgccgcagtagcagcctggcttgcttcgaaggaagccagctacgtcacaggcatcacgttattcgcggacggcggtatgacactgggcccttcaatccaggcaggccgcggt

SEQ ID NO: 722 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNLVKEEVIKAGGEAVVVQGDVTKEEDVKNIVQTAIKEFGTLDIMINNAGVSNPVPSHEMPLKDWDKVIGTNLTGAFLGSREAIKYFVENDIKGNVINMSSVIEVIPWPLRVHYAASKGGMKLMTKTLALEYAPKGIRVNNIGPGAINTTGNAERWADPKQKADVESMIGMGYIGEPEEIAAVAAWLASKEASYVTGITLFADGGMTLGPSIQAGRG

SEQ ID NO: 723 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgcgaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgatcgaagtgattccttggccgttaaacgtccactatgccgcaagtaaaggcgggatgaagcagatgacaaaaacattagcgttggaatacgcgccgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgagtccttcattccaggcaggccgcggt

SEQ ID NO: 724 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNLVKEEVIKAGGEAVVVQGDVTKEEDVKNIVQTAIKEFGTLDIMINNAGVANPVPSHEMPLKDWDKVIATNLTGAFLGSREAIKYFVENDIKGNVINMSSVIEVIPWPLNVHYAASKGGMKQMTKTLALEYAPKGIRVNNIGPGAINTTGNAERWADPKQKADVESMIPMGYIGEPEEIAAVAAWLASKEASYVTGITLFADGGMTLSPSFQAGRG

SEQ ID NO: 725 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcagcaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgatcgaagtgattccttggccgttacgcgtccactatgccgcaagtaaaggcgggatgaagctgatgacaaaaacattagcgttggaatacgcgccgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatggctctgggtccttcaattcaggcaggccgcggt

SEQ ID NO: 726 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNLVKEEVIKAGGEAVVVQGDVTKEEDVKNIVQTAIKEFGTLDIMINNAGVSNPVPSHEMPLKDWDKVIATNLTGAFLGSREAIKYFVENDIKGNVINMSSVIEVIPWPLRVHYAASKGGMKLMTKTLALEYAPKGIRVNNIGPGAINTTGNAERWADPKQKADVESMIPMGYIGEPEEIAAVAAWLASKEASYVTGITLFADGGMALGPSIQAGRG

SEQ ID NO: 727 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgattgaagaaattccttggccgttacgcgtccactatgccgcaagtaaaggcgggatgaagcagatgacaaaaacattagcgttggaatacgcgccgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgagtccttcattccaggcaggccgcggt

SEQ ID NO: 728 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNLVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVIEEIPWPLRVHYAASKGGMKQMTKTLALEYAPKGIRVNNIGPGAINTTGNAERWADPKQKADVESMIPMGYIGEPEEIAAVAAWLASKEASYVTGITLFADGGMTLSPSFQAGRG

SEQ ID NO: 729 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgatcgaagtgattccttggccgttacgcgtccactatgccgcaagtaaaggcgggatgaagctgatgacaaaaacattagcgttggaatacgcgccgaagggcattcgcgtcaataatattgggccaggtgcgatcaacacgacgggtaacgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgagcccttcattcgaggcaggccgcggt

SEQ ID NO: 730 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNLVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVIEVIPWPLRVHYAASKGGMKLMTKTLALEYAPKGIRVNNIGPGAINTTGNAERWADPKQKADVESMIPMGYIGEPEEIAAVAAWLASKEASYVTGITLFADGGMTLSPSFEAGRG

SEQ ID NO: 731 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgatcgaagtgattccttggccgttacgcgtccactatgccgcaagtaaaggcgggatgaagctgatgacaaaaacattagcgttggaatacgcgccgaagggcattcgcgtcaataatattgggccaggtgcgatcaacacgacgggtaacgctcaccgctgggctgaccctaaacagaaagctgatgtagaaagcatgattccgatgggatatattggcgaaccggaggagatcgccgcagtagcagcctggcttgcttcgaaggaagccagctacgtcacaggcatcacgttattcgcggacggcggtatgacactgggcccttcaatccaggcaggccgcggt

SEQ ID NO: 732 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNLVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVIEVIPWPLRVHYAASKGGMKLMTKTLALEYAPKGIRVNNIGPGAINTTGNAHRWADPKQKADVESMIPMGYIGEPEEIAAVAAWLASKEASYVTGITLFADGGMTLGPSIQAGRG

SEQ ID NO: 733 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcggtaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgatcgaagtgattccttggccgttaaacgtccactatgccgcaagtaaaggcgggatgaagcagatgacaaaaacattagcgttggaatacgcgccgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgagtccttcattccaggcaggccgcggt

SEQ ID NO: 734 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNLVKEEVIKAGGEAVVVQGDVTKEEDVKNIVQTAIKEFGTLDIMINNAGVGNPVPSHEMPLKDWDKVIATNLTGAFLGSREAIKYFVENDIKGNVINMSSVIEVIPWPLNVHYAASKGGMKQMTKTLALEYAPKGIRVNNIGPGAINTTGNAERWADPKQKADVESMIPMGYIGEPEEIAAVAAWLASKEASYVTGITLFADGGMTLSPSFQAGRG

SEQ ID NO: 735 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgcgtgaagtgattccttggccgttacgcgtccactatgccgcaagtaaaggcgggatgaagctgatgacaaaaacattagcgttggaatacgcgccgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgagtccttcattccaggcaggccgcggt

SEQ ID NO: 736 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNLVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREVIPWPLRVHYAASKGGMKLMTKTLALEYAPKGIRVNNIGPGAINTTGNAERWADPKQKADVESMIPMGYIGEPEEIAAVAAWLASKEASYVTGITLFADGGMTLSPSFQAGRG

SEQ ID NO: 737 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgatcgaagtgattccttggccgttacgcgtccactatgccgcaagtaaaggcgggatgaagcagatgacaaaaacattagcgttggaatacgcgccgaagggcattcgcgtcaataatattgggccaggtgcgatcaacacgacgaataatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatggctctgggtccttcatttcaggcaggccgcggt

SEQ ID NO: 738 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNLVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVIEVIPWPLRVHYAASKGGMKQMTKTLALEYAPKGIRVNNIGPGAINTTNNAERWADPKQKADVESMIPMGYIGEPEEIAAVAAWLASKEASYVTGITLFADGGMALGPSFQAGRG

SEQ ID NO: 739 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtctgtaatcctgtgccatctcacgaaatgccgctcaaggattgggataaagtcatcgccacgaacttaacgggtgcctttttaggaagccgtgaagcgattaaatatttcgtagaaaacgatatcaagggaaatgtcattaacatgtccagtgtgatcgaagtcattccttggccgttaaacgtccactatgccgcaagtaaaggcgggatgaagctgatgacaaaaacattagcgttggaatacgcgccgaagggcattcgcgtcaataatattgggccaggtgcgatcaacacgacgggtggtgctgagcgctgggctgaccctaaacagaaagctgatgtagaaagcatgattccgatgggatatccaggcgaaccggaggagatcgccgcagtagcagcctggcttgcttcgaaggaagccagctacgtcacaggcatcacgttattcgcggacggcggtatgacactgggcccttcaatcgaggcaggccgcggt

SEQ ID NO: 740 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNLVKEEVIKAGGEAVVVQGDVTKEEDVKNIVQTAIKEFGTLDIMINNAGVCNPVPSHEMPLKDWDKVIATNLTGAFLGSREAIKYFVENDIKGNVINMSSVIEVIPWPLNVHYAASKGGMKLMTKTLALEYAPKGIRVNNIGPGAINTTGGAERWADPKQKADVESMIPMGYPGEPEEIAAVAAWLASKEASYVTGITLFADGGMTLGPSIEAGRG

SEQ ID NO: 741 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgccacgaacttaacgggtgcctttttaggaagccgtgaagcgattaaatatttcgtagaaaacgatatcaagggaaatgtcattaacatgtccagtgtgatcgaagtgattccttggccgttaaacgtccactatgccgcaagtaaaggcgggatgaagctgatgacaaaaacattagcgttggaatacgcgccgaagggcattcgcgtcaataatattgggccaggtgcgatcaacacgacgggtggtgctcaccgctgggctgaccctaaacagaaagctgatgtagaaagcatgattccgatgggatatattggcgaaccggaggagatcgccgcagtagcagcctggcttgcttcgaaggaagccagctacgtcacaggcatcacgttattcgcggacggcggtatgacactgggcccttcattccaggcaggccgcggt

SEQ ID NO: 742 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNLVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVIEVIPWPLNVHYAASKGGMKLMTKTLALEYAPKGIRVNNIGPGAINTTGGAHRWADPKQKADVESMIPMGYIGEPEEIAAVAAWLASKEASYVTGITLFADGGMTLGPSFQAGRG

SEQ ID NO: 743 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgatcgaagaaattccttggccgttacgcgtccactatgccgcaagtaaaggcgggatgaagctgatgacaaaaacattagcgttggaatacgcgccgaagggcattcgcgtcaataatattgggccaggtgcgatcaacacgacgggtaatgctgagcgctgggctgaccctaaacagaaagctgatgtagaaagcatgattccgatgggatatccaggcgaaccggaggagatcgccgcagtagcagcctggcttgcttcgaaggaagccagctacgtcacaggcatcacgttattcgcggacggcggtatgacactgagtccttcattccaggcaggccgcggt

SEQ ID NO: 744 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNLVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVIEEIPWPLRVHYAASKGGMKLMTKTLALEYAPKGIRVNNIGPGAINTTGNAERWADPKQKADVESMIPMGYPGEPEEIAAVAAWLASKEASYVTGITLFADGGMTLSPSFQAGRG

SEQ ID NO: 745 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcaagaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgatcgaagtgattccttggccgttaaacgtccactatgccgcaagtaaaggcgggatgaagctgatgacaaaaacattagcgttggaatacgcgccgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgagtccttcattccaggcaggccgcggt

SEQ ID NO: 746 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNLVKEEVIKAGGEAVVVQGDVTKEEDVKNIVQTAIKEFGTLDIMINNAGVKNPVPSHEMPLKDWDKVIATNLTGAFLGSREAIKYFVENDIKGNVINMSSVIEVIPWPLNVHYAASKGGMKLMTKTLALEYAPKGIRVNNIGPGAINTTGNAERWADPKQKADVESMIPMGYIGEPEEIAAVAAWLASKEASYVTGITLFADGGMTLSPSFQAGRG

SEQ ID NO: 747 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgatcgaagtgattccttggccgttacgcgtccactatgccgcaagtaaaggcgggatgaagctgatgacaaaaacattagcgttggaatacgcgccgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgctgctgagtccttcattccaggcaggccgcggt

SEQ ID NO: 748 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNLVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVIEVIPWPLRVHYAASKGGMKLMTKTLALEYAPKGIRVNNIGPGAINTTGNAERWADPKQKADVESMIPMGYIGEPEEIAAVAAWLASKEASYVTGITLFADGGMLLSPSFQAGRG

SEQ ID NO: 749 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcagtaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgatcgaagtgattccttggccgttacgcgtccactatgccgcaagtaaaggcgggatgaagctgatgacaaaaacattagcgttggaatacgcgccgaagggcattcgcgtcaataatattgggccaggtgcgatcaacacgacgggtaacgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgagtccttcattccaggcaggccgcggt

SEQ ID NO: 750 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNLVKEEVIKAGGEAVVVQGDVTKEEDVKNIVQTAIKEFGTLDIMINNAGVSNPVPSHEMPLKDWDKVIATNLTGAFLGSREAIKYFVENDIKGNVINMSSVIEVIPWPLRVHYAASKGGMKLMTKTLALEYAPKGIRVNNIGPGAINTTGNAERWADPKQKADVESMIPMGYIGEPEEIAAVAAWLASKEASYVTGITLFADGGMTLSPSFQAGRG

SEQ ID NO: 751 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtctgtaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgatcgaagtgattccttggccgttacgcgtccactatgccgcaagtaaaggcgggatgaagctgatgacaaaaacattagcgttggaatacgcgccgaagggcattcgcgtcaataatattgggccaggtgcgatcaacacgacgggtggtgctgagcgctggcctgaccctaaacagaaagctgatgtagaaagcatgattccaatgggatatattggcgaaccggaggagatcgccgcagtagcagcctggcttgcttcgaaggaagccagctacgtcacaggcatcacgttattcgcggacggcggtatgacactgagcccttcaatccaggcaggccgcggt

SEQ ID NO: 752 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNLVKEEVIKAGGEAVVVQGDVTKEEDVKNIVQTAIKEFGTLDIMINNAGVCNPVPSHEMPLKDWDKVIATNLTGAFLGSREAIKYFVENDIKGNVINMSSVIEVIPWPLRVHYAASKGGMKLMTKTLALEYAPKGIRVNNIGPGAINTTGGAERWPDPKQKADVESMIPMGYIGEPEEIAAVAAWLASKEASYVTGITLFADGGMTLSPSIQAGRG

SEQ ID NO: 753 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtctgtaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaacgtccactatgccgcaagtaaaggcgggatgaagctgatgacaaaaacattagcgttggaatacgcgccgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacagccggcccttcattctgggcaggccgcggt

SEQ ID NO: 754 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNLVKEEVIKAGGEAVVVQGDVTKEEDVKNIVQTAIKEFGTLDIMINNAGVCNPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTGNAERWADPKQKADVESMIPMGYIGEPEEIAAVAAWLASKEASYVTGITLFADGGMTAGPSFWAGRG

SEQ ID NO: 755 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgattgaagaaattccttggccgttacgcgtccactatgccgcaagtaaaggcgggatgaagctgatgacaaaaacattagcgttggaatacgcgccgaagggcattcgcgtcaataatattgggccaggtgcgatcaacacgacgaataatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgagtccttcattccaggcaggccgcggt

SEQ ID NO: 756 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNLVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVIEEIPWPLRVHYAASKGGMKLMTKTLALEYAPKGIRVNNIGPGAINTTNNAERWADPKQKADVESMIPMGYIGEPEEIAAVAAWLASKEASYVTGITLFADGGMTLSPSFQAGRG

SEQ ID NO: 757 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgcgcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgactgaagaaattccttggccgttacgcgtccactatgccgcaagtaaaggcgggatgaagctgatgacaaaaacattagcgttggaatacgcgccgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgagtccttcattccaggcaggccgcggt

SEQ ID NO: 758 - protein, 261 aa, Artificial Sequence
  Variant of Glucose Dehydrogenase from Bacillus subtilis
MYPDLKGKVVAITGAATGLGRAMAIRFGKEQAKVVINYYSNKQDPNLVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVTEEIPWPLRVHYAASKGGMKLMTKTLALEYAPKGIRVNNIGPGAINTTGNAERWADPKQKADVESMIPMGYIGEPEEIAAVAAWLASKEASYVTGITLFADGGMTLSPSFQAGRG

SEQ ID NO: 759 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgcgaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgattgaagaaattccttggccgttaaacgtccactatgccgcaagtaaaggcgggatgaagcagatgacaaaaacattagcgttggaatacgcgtcgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgactctgggtccttcatttcaggcaggccgcggt

SEQ ID NO: 760 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNLVKEEVIKAGGEAVVVQGDVTKEEDVKNIVQTAIKEFGTLDIMINNAGVANPVPSHEMPLKDWDKVIATNLTGAFLGSREAIKYFVENDIKGNVINMSSVIEEIPWPLNVHYAASKGGMKQMTKTLALEYASKGIRVNNIGPGAINTTGNAERWADPKQKADVESMIPMGYIGEPEEIAAVAAWLASKEASYVTGITLFADGGMTLGPSFQAGRG

SEQ ID NO: 761 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcagtaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgatcgaagtcattccttggccgttacgcgtccactatgccgcaagtaaaggcgggatgaagctgatgacaaaaacattagcgttggaatacgcgccgaagggcattcgcgtcaataatattgggccaggtgcgatcaacacgacgggtaacgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgggcccttcattcgaggcaggccgcggt

SEQ ID NO: 762 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNLVKEEVIKAGGEAVVVQGDVTKEEDVKNIVQTAIKEFGTLDIMINNAGVSNPVPSHEMPLKDWDKVIATNLTGAFLGSREAIKYFVENDIKGNVINMSSVIEVIPWPLRVHYAASKGGMKLMTKTLALEYAPKGIRVNNIGPGAINTTGNAERWADPKQKADVESMIPMGYIGEPEEIAAVAAWLASKEASYVTGITLFADGGMTLGPSFEAGRG

SEQ ID NO: 763 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcagcaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgattgaagtaattccttggccgttaaacgtccactatgccgcaagtaaaggcgggatgaagctgatgacaaaaacattagcgttggaatacgcgccgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgagtccttcattccaggcaggccgcggt

SEQ ID NO: 764 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNLVKEEVIKAGGEAVVVQGDVTKEEDVKNIVQTAIKEFGTLDIMINNAGVSNPVPSHEMPLKDWDKVIATNLTGAFLGSREAIKYFVENDIKGNVINMSSVIEVIPWPLNVHYAASKGGMKLMTKTLALEYAPKGIRVNNIGPGAINTTGNAERWADPKQKADVESMIPMGYIGEPEEIAAVAAWLASKEASYVTGITLFADGGMTLSPSFQAGRG

SEQ ID NO: 765 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtctgtaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgatcgaagtgattccttggccgttacgcgtccactatgccgcaagtaaaggcgggatgaagctgatgacaaaaacattagcgttggaatacgcgccgaagggcattcgcgtcaataatattgggccaggtgcgatcaacacgacgaataatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgagtccttcatttcaggcaggccgcggt

SEQ ID NO: 766 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNLVKEEVIKAGGEAVVVQGDVTKEEDVKNIVQTAIKEFGTLDIMINNAGVCNPVPSHEMPLKDWDKVIATNLTGAFLGSREAIKYFVENDIKGNVINMSSVIEVIPWPLRVHYAASKGGMKLMTKTLALEYAPKGIRVNNIGPGAINTTNNAERWADPKQKADVESMIPMGYIGEPEEIAAVAAWLASKEASYVTGITLFADGGMTLSPSFQAGRG

SEQ ID NO: 767 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgcgcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtctgtaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgatcgaagtgattccttggccgttacgcgtccactatgccgcaagtaaaggcgggatgaagctgatgacaaaaacattagcgttggaatacgcgccgaagggcattcgcgtcaataatattgggccaggtgcgatcaacacgacgcgtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgagtccttcattccaggcaggccgcggt

SEQ ID NO: 768 - protein, 261 aa, Artificial Sequence
  Variant of Glucose Dehydrogenase from Bacillus subtilis
MYPDLKGKVVAITGAATGLGRAMAIRFGKEQAKVVINYYSNKQDPNLVKEEVIKAGGEAVVVQGDVTKEEDVKNIVQTAIKEFGTLDIMINNAGVCNPVPSHEMPLKDWDKVIATNLTGAFLGSREAIKYFVENDIKGNVINMSSVIEVIPWPLRVHYAASKGGMKLMTKTLALEYAPKGIRVNNIGPGAINTTRNAERWADPKQKADVESMIPMGYIGEPEEIAAVAAWLASKEASYVTGITLFADGGMTLSPSFQAGRG

SEQ ID NO: 769 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtctgtaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaacgtccactatgccgcaagtaaaggcgggatgaagctgatgacaaaaacattagcgttggaatacgcgccgaagggcattcgcgtcaataatattgggccaggtgcgatcaacacgacgggtaacgctgagcgctgggctgaccctaaacagaaagctgatgtagaaagcatgattccgatgggatatattggcgaaccggaggagatcgccgcagtagcagcctggcttgcttcgaaggaagccagctacgtcacaggcatcacgttattcgcggacggcggtatgacactgcgcccttcattccaggcaggccgcggt

SEQ ID NO: 770 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNLVKEEVIKAGGEAVVVQGDVTKEEDVKNIVQTAIKEFGTLDIMINNAGVCNPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTGNAERWADPKQKADVESMIPMGYIGEPEEIAAVAAWLASKEASYVTGITLFADGGMTLRPSFQAGRG

SEQ ID NO: 771 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcagtaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgatcgaagtgattccttggccgttacgcgtccactatgccgcaagtaaaggcgggatgaagctgatgacaaaaacattagcgttggaatacgcgccgaagggcattcgcgtcaataatattgggccaggtgcgatcaacacgacgggtggtgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgagtccttcattccaggcaggccgcggt

SEQ ID NO: 772 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNLVKEEVIKAGGEAVVVQGDVTKEEDVKNIVQTAIKEFGTLDIMINNAGVSNPVPSHEMPLKDWDKVIATNLTGAFLGSREAIKYFVENDIKGNVINMSSVIEVIPWPLRVHYAASKGGMKLMTKTLALEYAPKGIRVNNIGPGAINTTGGAERWADPKQKADVESMIPMGYIGEPEEIAAVAAWLASKEASYVTGITLFADGGMTLSPSFQAGRG

SEQ ID NO: 773 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaataagcaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtctgtaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgatcgaagtgattccttggccgttacgcgtccactatgccgcaagtaaaggcgggatgaagctgatgacaaaaacattagcgttggaatacgcgccgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgagtccttcattccaggcaggccgcggt

SEQ ID NO: 774 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNLVKEEVIKAGGEAVVVQGDVTKEEDVKNIVQTAIKEFGTLDIMINNAGVCNPVPSHEMPLKDWDKVIATNLTGAFLGSREAIKYFVENDIKGNVINMSSVIEVIPWPLRVHYAASKGGMKLMTKTLALEYAPKGIRVNNIGPGAINTTGNAERWADPKQKADVESMIPMGYIGEPEEIAAVAAWLASKEASYVTGITLFADGGMTLSPSFQAGRG

SEQ ID NO: 775 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgcgcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcagcaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgatcgaagtgattccttggccgttacgcgtccactatgccgcaagtaaaggcgggatgaagctgatgacaaaaacattagcgttggaatacgcgccgaatggcattcgcgtcaataatattgggccaggtgcgatcaacacgacgaataatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatggctctgggtccttcatttcaggcaggccgcggt

SEQ ID NO: 776 - protein, 261 aa, Artificial Sequence
  Variant of Glucose Dehydrogenase from Bacillus subtilis
MYPDLKGKVVAITGAATGLGRAMAIRFGKEQAKVVINYYSNKQDPNLVKEEVIKAGGEAVVVQGDVTKEEDVKNIVQTAIKEFGTLDIMINNAGVSNPVPSHEMPLKDWDKVIATNLTGAFLGSREAIKYFVENDIKGNVINMSSVIEVIPWPLRVHYAASKGGMKLMTKTLALEYAPNGIRVNNIGPGAINTTNNAERWADPKQKADVESMIPMGYIGEPEEIAAVAAWLASKEASYVTGITLFADGGMALGPSFQAGRG

SEQ ID NO: 777 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaataagcaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtctgtaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgactgaagtaattccttggccgttacgcgtccactatgccgcaagtaaaggcgggatgaagctgatgacaaaaacattagcgttggaatacgcgccgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgagtccttcattccaggcaggccgcggt

SEQ ID NO: 778 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNLVKEEVIKAGGEAVVVQGDVTKEEDVKNIVQTAIKEFGTLDIMINNAGVCNPVPSHEMPLKDWDKVIATNLTGAFLGSREAIKYFVENDIKGNVINMSSVTEVIPWPLRVHYAASKGGMKLMTKTLALEYAPKGIRVNNIGPGAINTTGNAERWADPKQKADVESMIPMGYIGEPEEIAAVAAWLASKEASYVTGITLFADGGMTLSPSFQAGRG

SEQ ID NO: 779 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcggtaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgatcgaagtgattccttggccgttaaacgtccactatgccgcaagtaaaggcgggatgaagctgatgacaaaaacattagcgttggaatacgcgccgaagggcattcgcgtcaataatattgggccaggtgcgatcaacacgacgcgtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgagtccttcattccaggcaggccgcggt

SEQ ID NO: 780 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNLVKEEVIKAGGEAVVVQGDVTKEEDVKNIVQTAIKEFGTLDIMINNAGVGNPVPSHEMPLKDWDKVIATNLTGAFLGSREAIKYFVENDIKGNVINMSSVIEVIPWPLNVHYAASKGGMKLMTKTLALEYAPKGIRVNNIGPGAINTTRNAERWADPKQKADVESMIPMGYIGEPEEIAAVAAWLASKEASYVTGITLFADGGMTLSPSFQAGRG

SEQ ID NO: 781 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgcgcgatggccattcgcttcggcaaggagcaggcaaaagtggttatcaactattatagtaatacgcaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtctgtaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgatcgaagtgattccttggccgttacgcgtccactatgccgcaagtaaaggcgggatgaagctgatgacaaaaacattagcgttggaatacgcgtcgaagggcattcgcgtcaataatattgggccaggtgcgatcaacacgacgaataatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgactctgggtccttcatttcaggcaggccgcggt

SEQ ID NO: 782 - protein, 261 aa, Artificial Sequence
  Variant of Glucose Dehydrogenase from Bacillus subtilis
MYPDLKGKVVAITGAATGLGRAMAIRFGKEQAKVVINYYSNTQDPNLVKEEVIKAGGEAVVVQGDVTKEEDVKNIVQTAIKEFGTLDIMINNAGVCNPVPSHEMPLKDWDKVIATNLTGAFLGSREAIKYFVENDIKGNVINMSSVIEVIPWPLRVHYAASKGGMKLMTKTLALEYASKGIRVNNIGPGAINTTNNAERWADPKQKADVESMIPMGYIGEPEEIAAVAAWLASKEASYVTGITLFADGGMTLGPSFQAGRG

SEQ ID NO: 783 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgatcgaagtgattccttggccgttaaacgtccactatgccgcaagtaaaggcgggatgaagctgatgacaaaaacattagcgttggaatacgcgtcgaagggcattcgcgtcaataatattgggccaggtgcgatcaacacgacgcgtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgagtccttcattccaggcaggccgcggt

SEQ ID NO: 784 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNLVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVIEVIPWPLNVHYAASKGGMKLMTKTLALEYASKGIRVNNIGPGAINTTRNAERWADPKQKADVESMIPMGYIGEPEEIAAVAAWLASKEASYVTGITLFADGGMTLSPSFQAGRG

SEQ ID NO: 785 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcagtaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttaaacgtccactatgccgcaagtaaaggcgggatgaagctgatgacaaaaacattagcgttggaatacgcgccgaagggcattcgcgtcaataatattgggccaggtgcgatcaacacgacgggtaacgctcaccgctgggctgaccctaaacagaaagctgatgtagaaagcatgattccgatgggatatccaggcgaaccggaggagatcgccgcagtagcagcctggcttgcttcgaaggaagccagctacgtcacaggcatcacgttattcgcggacggcggtatgacactgcgcccttcaatcgaggcaggccgcggt

SEQ ID NO: 786 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNLVKEEVIKAGGEAVVVQGDVTKEEDVKNIVQTAIKEFGTLDIMINNAGVSNPVPSHEMPLKDWDKVIGTNLTGAFLGSREAIKYFVENDIKGNVINMSSVIEVIPWPLNVHYAASKGGMKLMTKTLALEYAPKGIRVNNIGPGAINTTGNAHRWADPKQKADVESMIPMGYPGEPEEIAAVAAWLASKEASYVTGITLFADGGMTLRPSIEAGRG

SEQ ID NO: 787 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtctgtaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtcattccttggccgttacgcgtccactatgccgcaagtaaaggcgggatgaagctgatgacaaaaacattagcgttggaatacgcgccgaagggcattcgcgtcaataatattgggccaggtgcgatcaacacgacgggtggtgctgagcgctgggctgaccctaaacagaaagctgatgtagaaagcatgattggtatgggatatattggcgaaccggaggagatcgccgcagtagcagcctggcttgcttcgaaggaagccagctacgtcacaggcatcacgttattcgcggacggcggtatgacactgggcccttcaatccaggcaggccgcggt

SEQ ID NO: 788 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNLVKEEVIKAGGEAVVVQGDVTKEEDVKNIVQTAIKEFGTLDIMINNAGVCNPVPSHEMPLKDWDKVIGTNLTGAFLGSREAIKYFVENDIKGNVINMSSVIEVIPWPLRVHYAASKGGMKLMTKTLALEYAPKGIRVNNIGPGAINTTGGAERWADPKQKADVESMIGMGYIGEPEEIAAVAAWLASKEASYVTGITLFADGGMTLGPSIQAGRG

SEQ ID NO: 789 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgcgcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcaagaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgatcgaagtgattccttggccgttacgcgtccactatgccgcaagtaaaggcgggatgaagcagatgacaaaaacattagcgttggaatacgcgccgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgagtccttcattccaggcaggccgcggt

SEQ ID NO: 790 - protein, 261 aa, Artificial Sequence
  Variant of Glucose Dehydrogenase from Bacillus subtilis
MYPDLKGKVVAITGAATGLGRAMAIRFGKEQAKVVINYYSNKQDPNLVKEEVIKAGGEAVVVQGDVTKEEDVKNIVQTAIKEFGTLDIMINNAGVKNPVPSHEMPLKDWDKVIATNLTGAFLGSREAIKYFVENDIKGNVINMSSVIEVIPWPLRVHYAASKGGMKQMTKTLALEYAPKGIRVNNIGPGAINTTGNAERWADPKQKADVESMIPMGYIGEPEEIAAVAAWLASKEASYVTGITLFADGGMTLSPSFQAGRG

SEQ ID NO: 791 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtctgtaatcctgtgccatctcacgaaatgccgctcaaggattgggataaagtcatcgccacgaacttaacgggtgcctttttaggaagccgtgaagcgattaaatatttcgtagaaaacgatatcaagggaaatgtcattaacatgtccagtgtgatcgaagtgattccttggccgttaaacgtccactatgccgcaagtaaaggcgggatgaagctgatgacaaaaacattagcgttggaatacgcgccgaagggcattcgcgtcaataatattgggccaggtgcgatcaacacgacgggtaacgctcaccgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgagtccttcattccaggcaggccgcggt

SEQ ID NO: 792 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNLVKEEVIKAGGEAVVVQGDVTKEEDVKNIVQTAIKEFGTLDIMINNAGVCNPVPSHEMPLKDWDKVIATNLTGAFLGSREAIKYFVENDIKGNVINMSSVIEVIPWPLNVHYAASKGGMKLMTKTLALEYAPKGIRVNNIGPGAINTTGNAHRWADPKQKADVESMIPMGYIGEPEEIAAVAAWLASKEASYVTGITLFADGGMTLSPSFQAGRG

SEQ ID NO: 793 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgatcgaagtgattccttggccgttaaacgtccactatgccgcaagtaaaggcgggatgaagctgatgacaaaaacattagcgttggaatacgcgccgaagggcattcgcgtcaataatattgggccaggtgcgatcaacacgacgaataatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatggctctgggtccttcaattcaggcaggccgcggt

SEQ ID NO: 794 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNLVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVIEVIPWPLNVHYAASKGGMKLMTKTLALEYAPKGIRVNNIGPGAINTTNNAERWADPKQKADVESMIPMGYIGEPEEIAAVAAWLASKEASYVTGITLFADGGMALGPSIQAGRG

SEQ ID NO: 795 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgcgcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtctgtaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgatcgaagtgattccttggccgttacgcgtccactatgccgcaagtaaaggcgggatgaagctgatgacaaaaacattagcgttggaatacgcgtcgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgagtccttcattccaggcaggccgcggt

SEQ ID NO: 796 - protein, 261 aa, Artificial Sequence
  Variant of Glucose Dehydrogenase from Bacillus subtilis
MYPDLKGKVVAITGAATGLGRAMAIRFGKEQAKVVINYYSNKQDPNLVKEEVIKAGGEAVVVQGDVTKEEDVKNIVQTAIKEFGTLDIMINNAGVCNPVPSHEMPLKDWDKVIATNLTGAFLGSREAIKYFVENDIKGNVINMSSVIEVIPWPLRVHYAASKGGMKLMTKTLALEYASKGIRVNNIGPGAINTTGNAERWADPKQKADVESMIPMGYIGEPEEIAAVAAWLASKEASYVTGITLFADGGMTLSPSFQAGRG

SEQ ID NO: 797 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgcgcgatggccattcgcttcggcaaggagcaggcaaaagtggttatcaactattatagtaatacgcaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcagcaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgatcgaagtgattccttggccgttacgcgtccactatgccgcaagtaaaggcgggatgaagctgatgacaaaaacattagcgttggaatacgcgccgaagggcattcgcgtcaataatattgggccaggtgcgatcaacacgacgcgtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgactctgagtccttcatttcaggcaggccgcggt

SEQ ID NO: 798 - protein, 261 aa, Artificial Sequence
  Variant of Glucose Dehydrogenase from Bacillus subtilis
MYPDLKGKVVAITGAATGLGRAMAIRFGKEQAKVVINYYSNTQDPNLVKEEVIKAGGEAVVVQGDVTKEEDVKNIVQTAIKEFGTLDIMINNAGVSNPVPSHEMPLKDWDKVIATNLTGAFLGSREAIKYFVENDIKGNVINMSSVIEVIPWPLRVHYAASKGGMKLMTKTLALEYAPKGIRVNNIGPGAINTTRNAERWADPKQKADVESMIPMGYIGEPEEIAAVAAWLASKEASYVTGITLFADGGMTLSPSFQAGRG

SEQ ID NO: 799 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgcgcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgatcgaagtgattccttggccgttacgcgtccactatgccgcaagtaaaggcgggatgaagctgatgacaaaaacattagcgttggaatacgcgtcgaagggcattcgcgtcaataatattgggccaggtgcgatcaacacgacgcgtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgactctgagtccttcaattcaggcaggccgcggt

SEQ ID NO: 800 - protein, 261 aa, Artificial Sequence
  Variant of Glucose Dehydrogenase from Bacillus subtilis
MYPDLKGKVVAITGAATGLGRAMAIRFGKEQAKVVINYYSNKQDPNLVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVIEVIPWPLRVHYAASKGGMKLMTKTLALEYASKGIRVNNIGPGAINTTRNAERWADPKQKADVESMIPMGYIGEPEEIAAVAAWLASKEASYVTGITLFADGGMTLSPSIQAGRG

SEQ ID NO: 801 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcagcaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgatcgaagtgattccttggccgttaaacgtccactatgccgcaagtaaaggcgggatgaagcagatgacaaaaacattagcgttggaatacgcgtcgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgactctgagtccttcatttcaggcaggccgcggt

SEQ ID NO: 802 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNLVKEEVIKAGGEAVVVQGDVTKEEDVKNIVQTAIKEFGTLDIMINNAGVSNPVPSHEMPLKDWDKVIATNLTGAFLGSREAIKYFVENDIKGNVINMSSVIEVIPWPLNVHYAASKGGMKQMTKTLALEYASKGIRVNNIGPGAINTTGNAERWADPKQKADVESMIPMGYIGEPEEIAAVAAWLASKEASYVTGITLFADGGMTLSPSFQAGRG

SEQ ID NO: 803 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatgcggtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgatcgaagtgattccttggccgttacgcgtccactatgccgcaagtaaaggcgggatgaagctgatgacaaaaacattagcgttggaatacgcgccgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgagtccttcattccaggcaggccgcggt

SEQ ID NO: 804 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNLVKEEVIKAGGEAVVVQGDVTKEEDVKNIVQTAIKEFGTLDIMINNAGVENAVPSHEMPLKDWDKVIATNLTGAFLGSREAIKYFVENDIKGNVINMSSVIEVIPWPLRVHYAASKGGMKLMTKTLALEYAPKGIRVNNIGPGAINTTGNAERWADPKQKADVESMIPMGYIGEPEEIAAVAAWLASKEASYVTGITLFADGGMTLSPSFQAGRG

SEQ ID NO: 805 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgatcgaagtgattccttggccgttaaacgtccactatgccgcaagtaaaggcgggatgaagctgatgacaaaaacattagcgttggaatacgcgtcgaagggcattcgcgtcaataatattgggccaggtgcgatcaacacgacgcgtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatggctctgggtccttcatttcaggcaggccgcggt

SEQ ID NO: 806 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNLVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVIEVIPWPLNVHYAASKGGMKLMTKTLALEYASKGIRVNNIGPGAINTTRNAERWADPKQKADVESMIPMGYIGEPEEIAAVAAWLASKEASYVTGITLFADGGMALGPSFQAGRG

SEQ ID NO: 807 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgcgcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtctgtaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgactgaagtaattccttggccgttacgcgtccactatgccgcaagtaaaggcgggatgaagctgatgacaaaaacattagcgttggaatacgcgccgaagggcattcgcgtcaataatattgggccaggtgcgatcaacacgacgcgtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgagtccttcattccaggcaggccgcggt

SEQ ID NO: 808 - protein, 261 aa, Artificial Sequence
  Variant of Glucose Dehydrogenase from Bacillus subtilis
MYPDLKGKVVAITGAATGLGRAMAIRFGKEQAKVVINYYSNKQDPNLVKEEVIKAGGEAVVVQGDVTKEEDVKNIVQTAIKEFGTLDIMINNAGVCNPVPSHEMPLKDWDKVIATNLTGAFLGSREAIKYFVENDIKGNVINMSSVTEVIPWPLRVHYAASKGGMKLMTKTLALEYAPKGIRVNNIGPGAINTTRNAERWADPKQKADVESMIPMGYIGEPEEIAAVAAWLASKEASYVTGITLFADGGMTLSPSFQAGRG

SEQ ID NO: 809 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcagcaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgatcgaagtgattccttggccgttacgcgtccactatgccgcaagtaaaggcgggatgaagctgatgacaaaaacattagcgttggaatacgcgtcgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgagtccttcattccaggcaggccgcggt

SEQ ID NO: 810 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNLVKEEVIKAGGEAVVVQGDVTKEEDVKNIVQTAIKEFGTLDIMINNAGVSNPVPSHEMPLKDWDKVIATNLTGAFLGSREAIKYFVENDIKGNVINMSSVIEVIPWPLRVHYAASKGGMKLMTKTLALEYASKGIRVNNIGPGAINTTGNAERWADPKQKADVESMIPMGYIGEPEEIAAVAAWLASKEASYVTGITLFADGGMTLSPSFQAGRG

SEQ ID NO: 811 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaataagcaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcagcaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgattgaagaaattccttggccgttacgcgtccactatgccgcaagtaaaggcgggatgaagctgatgacaaaaacattagcgttggaatacgcgtcgaatggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatggctctgagtccttcaattcaggcaggccgcggt

SEQ ID NO: 812 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNLVKEEVIKAGGEAVVVQGDVTKEEDVKNIVQTAIKEFGTLDIMINNAGVSNPVPSHEMPLKDWDKVIATNLTGAFLGSREAIKYFVENDIKGNVINMSSVIEEIPWPLRVHYAASKGGMKLMTKTLALEYASNGIRVNNIGPGAINTTGNAERWADPKQKADVESMIPMGYIGEPEEIAAVAAWLASKEASYVTGITLFADGGMALSPSIQAGRG

SEQ ID NO: 813 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgatcgaagtgattccttggccgttacgcgtccactatgccgcaagtaaaggcgggatgaagctgatgacaaaaacattagcgttggaatacgcgccgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgggcccttcaatcgaggcaggccgcggt

SEQ ID NO: 814 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNLVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVIEVIPWPLRVHYAASKGGMKLMTKTLALEYAPKGIRVNNIGPGAINTTGNAERWADPKQKADVESMIPMGYIGEPEEIAAVAAWLASKEASYVTGITLFADGGMTLGPSIEAGRG

SEQ ID NO: 815 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcgccacgaacttaacgggtgcctttttaggaagccgtgaagcgattaaatatttcgtagaaaacgatatcaagggaaatgtcattaacatgtccagtgtgatcgaagaaattccttggccgttacgcgtccactatgccgcaagtaaaggcgggatgaagctgatgacaaaaacattagcgttggaatacgcgccgaagggcattcgcgtcaataatattgggccaggtgcgatcaacacgacgggtaatgctgagcgctgggctgaccctaaacagaaagctgatgtagaaagcatgattccgatgggatatattggcgaaccggaggagatcgccgcagtagcagcctggcttgcttcgaaggaagccagctacgtcacaggcatcacgttattcgcggacggcggtatgacactgggcccttcattccaggcaggccgcggt

SEQ ID NO: 816 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNLVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVIEEIPWPLRVHYAASKGGMKLMTKTLALEYAPKGIRVNNIGPGAINTTGNAERWADPKQKADVESMIPMGYIGEPEEIAAVAAWLASKEASYVTGITLFADGGMTLGPSFQAGRG

SEQ ID NO: 817 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcaagaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgattgaagtaattccttggccgttacgcgtccactatgccgcaagtaaaggcgggatgaagctgatgacaaaaacattagcgttggaatacgcgtcgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgagtccttcattccaggcaggccgcggt

SEQ ID NO: 818 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNLVKEEVIKAGGEAVVVQGDVTKEEDVKNIVQTAIKEFGTLDIMINNAGVKNPVPSHEMPLKDWDKVIATNLTGAFLGSREAIKYFVENDIKGNVINMSSVIEVIPWPLRVHYAASKGGMKLMTKTLALEYASKGIRVNNIGPGAINTTGNAERWADPKQKADVESMIPMGYIGEPEEIAAVAAWLASKEASYVTGITLFADGGMTLSPSFQAGRG

SEQ ID NO: 819 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcagcaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgatcgaagtgattccttggccgttacgcgtccactatgccgcaagtaaaggcgggatgaagctgatgacaaaaacattagcgttggaatacgcgtcgaatggcattcgcgtcaataatattgggccaggtgcgatcaacacgacgaataatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgagtccttcattccaggcaggccgcggt

SEQ ID NO: 820 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNLVKEEVIKAGGEAVVVQGDVTKEEDVKNIVQTAIKEFGTLDIMINNAGVSNPVPSHEMPLKDWDKVIATNLTGAFLGSREAIKYFVENDIKGNVINMSSVIEVIPWPLRVHYAASKGGMKLMTKTLALEYASNGIRVNNIGPGAINTTNNAERWADPKQKADVESMIPMGYIGEPEEIAAVAAWLASKEASYVTGITLFADGGMTLSPSFQAGRG

SEQ ID NO: 821 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtctgtaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgactgaagaaattccttggccgttatgcgtccactatgccgcaagtaaaggcgggatgaagctgatgacaaaaacattagcgttggaatacgcgccgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgagtccttcattccaggcaggccgcggt

SEQ ID NO: 822 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNLVKEEVIKAGGEAVVVQGDVTKEEDVKNIVQTAIKEFGTLDIMINNAGVCNPVPSHEMPLKDWDKVIATNLTGAFLGSREAIKYFVENDIKGNVINMSSVTEEIPWPLCVHYAASKGGMKLMTKTLALEYAPKGIRVNNIGPGAINTTGNAERWADPKQKADVESMIPMGYIGEPEEIAAVAAWLASKEASYVTGITLFADGGMTLSPSFQAGRG

SEQ ID NO: 823 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgcgcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcggtaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgattgaagtaattccttggccgttacgcgtccactatgccgcaagtaaaggcgggatgaagcagatgacaaaaacattagcgttggaatacgcgccgaagggcattcgcgtcaataatattgggccaggtgcgatcaacacgacgaataatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgagtccttcatttcaggcaggccgcggt

SEQ ID NO: 824 - protein, 261 aa, Artificial Sequence
  Variant of Glucose Dehydrogenase from Bacillus subtilis
MYPDLKGKVVAITGAATGLGRAMAIRFGKEQAKVVINYYSNKQDPNLVKEEVIKAGGEAVVVQGDVTKEEDVKNIVQTAIKEFGTLDIMINNAGVGNPVPSHEMPLKDWDKVIATNLTGAFLGSREAIKYFVENDIKGNVINMSSVIEVIPWPLRVHYAASKGGMKQMTKTLALEYAPKGIRVNNIGPGAINTTNNAERWADPKQKADVESMIPMGYIGEPEEIAAVAAWLASKEASYVTGITLFADGGMTLSPSFQAGRG

SEQ ID NO: 825 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgcgcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgactgaagtaattccttggccgttacgcgtccactatgccgcaagtaaaggcgggatgaagctgatgacaaaaacattagcgttggaatacgcgccgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgactctgggtccttcatttcaggcaggccgcggt

SEQ ID NO: 826 - protein, 261 aa, Artificial Sequence
  Variant of Glucose Dehydrogenase from Bacillus subtilis
MYPDLKGKVVAITGAATGLGRAMAIRFGKEQAKVVINYYSNKQDPNLVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVTEVIPWPLRVHYAASKGGMKLMTKTLALEYAPKGIRVNNIGPGAINTTGNAERWADPKQKADVESMIPMGYIGEPEEIAAVAAWLASKEASYVTGITLFADGGMTLGPSFQAGRG

SEQ ID NO: 827 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgactgaagtgattccttggccgttacgcgtccactatgccgcaagtaaaggcgggatgaagctgatgacaaaaacattagcgttggaatacgcgccgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgagtccttcattccaggcaggccgcggt

SEQ ID NO: 828 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNLVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVTEVIPWPLRVHYAASKGGMKLMTKTLALEYAPKGIRVNNIGPGAINTTGNAERWADPKQKADVESMIPMGYIGEPEEIAAVAAWLASKEASYVTGITLFADGGMTLSPSFQAGRG

SEQ ID NO: 829 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcagcaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgatcgaagtgattccttggccgttacgcgtccactatgccgcaagtaaaggcgggatgaagctgatgacaaaaacattagcgttggaatacgcgccgaagggcattcgcgtcaataatattgggccaggtgcgatcaacacgacgaataatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgagtccttcattccaggcaggccgcggt

SEQ ID NO: 830 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNLVKEEVIKAGGEAVVVQGDVTKEEDVKNIVQTAIKEFGTLDIMINNAGVSNPVPSHEMPLKDWDKVIATNLTGAFLGSREAIKYFVENDIKGNVINMSSVIEVIPWPLRVHYAASKGGMKLMTKTLALEYAPKGIRVNNIGPGAINTTNNAERWADPKQKADVESMIPMGYIGEPEEIAAVAAWLASKEASYVTGITLFADGGMTLSPSFQAGRG

SEQ ID NO: 831 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgatcgaagtgattccttggccgttacgcgtccactatgccgcaagtaaaggcgggatgaagctgatgacaaaaacattagcgttggaatacgcgccgaagggcattcgcgtcaataatattgggccaggtgcgatcaacacgacgggtggtgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgggcccttcaatctgggcaggccgcggt

SEQ ID NO: 832 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNLVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVIEVIPWPLRVHYAASKGGMKLMTKTLALEYAPKGIRVNNIGPGAINTTGGAERWADPKQKADVESMIPMGYIGEPEEIAAVAAWLASKEASYVTGITLFADGGMTLGPSIWAGRG

SEQ ID NO: 833 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgcgcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcagcaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgatcgaagtgattccttggccgttacgcgtccactatgccgcaagtaaaggcgggatgaagctgatgacaaaaacattagcgttggaatacgcgtcgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgagtccttcattccaggcaggccgcggt

SEQ ID NO: 834 - protein, 261 aa, Artificial Sequence
  Variant of Glucose Dehydrogenase from Bacillus subtilis
MYPDLKGKVVAITGAATGLGRAMAIRFGKEQAKVVINYYSNKQDPNLVKEEVIKAGGEAVVVQGDVTKEEDVKNIVQTAIKEFGTLDIMINNAGVSNPVPSHEMPLKDWDKVIATNLTGAFLGSREAIKYFVENDIKGNVINMSSVIEVIPWPLRVHYAASKGGMKLMTKTLALEYASKGIRVNNIGPGAINTTGNAERWADPKQKADVESMIPMGYIGEPEEIAAVAAWLASKEASYVTGITLFADGGMTLSPSFQAGRG

SEQ ID NO: 835 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtctgtaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgactgaagtaattccttggccgttacgcgtccactatgccgcaagtaaaggcgggatgaagcagatgacaaaaacattagcgttggaatacgcgccgaagggcattcgcgtcaataatattgggccaggtgcgatcaacacgacgaataatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgagtccttcattccaggcaggccgcggt

SEQ ID NO: 836 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNLVKEEVIKAGGEAVVVQGDVTKEEDVKNIVQTAIKEFGTLDIMINNAGVCNPVPSHEMPLKDWDKVIATNLTGAFLGSREAIKYFVENDIKGNVINMSSVTEVIPWPLRVHYAASKGGMKQMTKTLALEYAPKGIRVNNIGPGAINTTNNAERWADPKQKADVESMIPMGYIGEPEEIAAVAAWLASKEASYVTGITLFADGGMTLSPSFQAGRG

SEQ ID NO: 837 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgcgcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtctgtaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgattgaagaaattccttggccgttacgcgtccactatgccgcaagtaaaggcgggatgaagctgatgacaaaaacattagcgttggaatacgcgccgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgagtccttcattccaggcaggccgcggt

SEQ ID NO: 838 - protein, 261 aa, Artificial Sequence
  Variant of Glucose Dehydrogenase from Bacillus subtilis
MYPDLKGKVVAITGAATGLGRAMAIRFGKEQAKVVINYYSNKQDPNLVKEEVIKAGGEAVVVQGDVTKEEDVKNIVQTAIKEFGTLDIMINNAGVCNPVPSHEMPLKDWDKVIATNLTGAFLGSREAIKYFVENDIKGNVINMSSVIEEIPWPLRVHYAASKGGMKLMTKTLALEYAPKGIRVNNIGPGAINTTGNAERWADPKQKADVESMIPMGYIGEPEEIAAVAAWLASKEASYVTGITLFADGGMTLSPSFQAGRG

SEQ ID NO: 839 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaataagcaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcagcaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgatcgaagtgattccttggccgttacgcgtccactatgccgcaagtaaaggcgggatgaagcagatgacaaaaacattagcgttggaatacgcgccgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgagtccttcattccaggcaggccgcggt

SEQ ID NO: 840 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNLVKEEVIKAGGEAVVVQGDVTKEEDVKNIVQTAIKEFGTLDIMINNAGVSNPVPSHEMPLKDWDKVIATNLTGAFLGSREAIKYFVENDIKGNVINMSSVIEVIPWPLRVHYAASKGGMKQMTKTLALEYAPKGIRVNNIGPGAINTTGNAERWADPKQKADVESMIPMGYIGEPEEIAAVAAWLASKEASYVTGITLFADGGMTLSPSFQAGRG

SEQ ID NO: 841 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgcgcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgattgaagaaattccttggccgttacgcgtccactatgccgcaagtaaaggcgggatgaagctgatgacaaaaacattagcgttggaatacgcgtcgaagggcattcgcgtcaataatattgggccaggtgcgatcaacacgacgaataatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgagtccttcattccaggcaggccgcggt

SEQ ID NO: 842 - protein, 261 aa, Artificial Sequence
  Variant of Glucose Dehydrogenase from Bacillus subtilis
MYPDLKGKVVAITGAATGLGRAMAIRFGKEQAKVVINYYSNKQDPNLVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVIEEIPWPLRVHYAASKGGMKLMTKTLALEYASKGIRVNNIGPGAINTTNNAERWADPKQKADVESMIPMGYIGEPEEIAAVAAWLASKEASYVTGITLFADGGMTLSPSFQAGRG

SEQ ID NO: 843 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcagcaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgactgaagaaattccttggccgttacgcgtccactatgccgcaagtaaaggcgggatgaagctgatgacaaaaacattagcgttggaatacgcgccgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgactctgagtccttcattccaggcaggccgcggt

SEQ ID NO: 844 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNLVKEEVIKAGGEAVVVQGDVTKEEDVKNIVQTAIKEFGTLDIMINNAGVSNPVPSHEMPLKDWDKVIATNLTGAFLGSREAIKYFVENDIKGNVINMSSVTEEIPWPLRVHYAASKGGMKLMTKTLALEYAPKGIRVNNIGPGAINTTGNAERWADPKQKADVESMIPMGYIGEPEEIAAVAAWLASKEASYVTGITLFADGGMTLSPSFQAGRG

SEQ ID NO: 845 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgcgcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcagcaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgatcgaagtgattccttggccgttacgcgtccactatgccgcaagtaaaggcgggatgaagctgatgacaaaaacattagcgttggaatacgcgccgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgagtccttcattccaggcaggccgcggt

SEQ ID NO: 846 - protein, 261 aa, Artificial Sequence
  Variant of Glucose Dehydrogenase from Bacillus subtilis
MYPDLKGKVVAITGAATGLGRAMAIRFGKEQAKVVINYYSNKQDPNLVKEEVIKAGGEAVVVQGDVTKEEDVKNIVQTAIKEFGTLDIMINNAGVSNPVPSHEMPLKDWDKVIATNLTGAFLGSREAIKYFVENDIKGNVINMSSVIEVIPWPLRVHYAASKGGMKLMTKTLALEYAPKGIRVNNIGPGAINTTGNAERWADPKQKADVESMIPMGYIGEPEEIAAVAAWLASKEASYVTGITLFADGGMTLSPSFQAGRG

SEQ ID NO: 847 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcggtaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgattgaagaaattccttggccgttacgcgtccactatgccgcaagtaaaggcgggatgaagctgatgacaaaaacattagcgttggaatacgcgtcgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgactctgggtccttcatttcaggcaggccgcggt

SEQ ID NO: 848 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNLVKEEVIKAGGEAVVVQGDVTKEEDVKNIVQTAIKEFGTLDIMINNAGVGNPVPSHEMPLKDWDKVIATNLTGAFLGSREAIKYFVENDIKGNVINMSSVIEEIPWPLRVHYAASKGGMKLMTKTLALEYASKGIRVNNIGPGAINTTGNAERWADPKQKADVESMIPMGYIGEPEEIAAVAAWLASKEASYVTGITLFADGGMTLGPSFQAGRG

SEQ ID NO: 849 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgactgaagaaattccttggccgttacgcgtccactatgccgcaagtaaaggcgggatgaagctgatgacaaaaacattagcgttggaatacgcgccgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgagtccttcattccaggcaggccgcggt

SEQ ID NO: 850 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNLVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVTEEIPWPLRVHYAASKGGMKLMTKTLALEYAPKGIRVNNIGPGAINTTGNAERWADPKQKADVESMIPMGYIGEPEEIAAVAAWLASKEASYVTGITLFADGGMTLSPSFQAGRG

SEQ ID NO: 851 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgcgcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgatcgaagtgattccttggccgttaaacgtccactatgccgcaagtaaaggcgggatgaagctgatgacaaaaacattagcgttggaatacgcgtcgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgactctgggtccttcaattcaggcaggccgcggt

SEQ ID NO: 852 - protein, 261 aa, Artificial Sequence
  Variant of Glucose Dehydrogenase from Bacillus subtilis
MYPDLKGKVVAITGAATGLGRAMAIRFGKEQAKVVINYYSNKQDPNLVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVIEVIPWPLNVHYAASKGGMKLMTKTLALEYASKGIRVNNIGPGAINTTGNAERWADPKQKADVESMIPMGYIGEPEEIAAVAAWLASKEASYVTGITLFADGGMTLGPSIQAGRG

SEQ ID NO: 853 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgatcgaagtgattccttggccgttaaacgtccactatgccgcaagtaaaggcgggatgaagctgatgacaaaaacattagcgttggaatacgcgccgaagggcattcgcgtcaataatattgggccaggtgcgatcaacacgacgaataatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgactctgggtccttcaattcaggcaggccgcggt

SEQ ID NO: 854 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNLVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVIEVIPWPLNVHYAASKGGMKLMTKTLALEYAPKGIRVNNIGPGAINTTNNAERWADPKQKADVESMIPMGYIGEPEEIAAVAAWLASKEASYVTGITLFADGGMTLGPSIQAGRG

SEQ ID NO: 855 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtctgtaatcctgtgccatctcacgaaatgccgctcaaggattgggataaagtcatcgccacgaacttaacgggtgcctttttaggaagccgtgaagcgattaaatatttcgtagaaaacgatatcaagggaaatgtcattaacatgtccagtgtgatcgaagtgattccttggccgttacgcgtccactatgccgcaagtaaaggcgggatgaagctgatgacaaaaacattagcgttggaatacgcgccgaagggcattcgcgtcaataatattgggccaggtgcgatcaacacgacgggtggtgctcaccgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgagtccttcattccaggcaggccgcggt

SEQ ID NO: 856 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNLVKEEVIKAGGEAVVVQGDVTKEEDVKNIVQTAIKEFGTLDIMINNAGVCNPVPSHEMPLKDWDKVIATNLTGAFLGSREAIKYFVENDIKGNVINMSSVIEVIPWPLRVHYAASKGGMKLMTKTLALEYAPKGIRVNNIGPGAINTTGGAHRWADPKQKADVESMIPMGYIGEPEEIAAVAAWLASKEASYVTGITLFADGGMTLSPSFQAGRG

SEQ ID NO: 857 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgcgcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcggtaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgatcgaagtgattccttggccgttaaacgtccactatgccgcaagtaaaggcgggatgaagctgatgacaaaaacattagcgttggaatacgcgccgaagggcattcgcgtcaataatattgggccaggtgcgatcaacacgacgcgtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgactctgggtccttcatttcaggcaggccgcggt

SEQ ID NO: 858 - protein, 261 aa, Artificial Sequence
  Variant of Glucose Dehydrogenase from Bacillus subtilis
MYPDLKGKVVAITGAATGLGRAMAIRFGKEQAKVVINYYSNKQDPNLVKEEVIKAGGEAVVVQGDVTKEEDVKNIVQTAIKEFGTLDIMINNAGVGNPVPSHEMPLKDWDKVIATNLTGAFLGSREAIKYFVENDIKGNVINMSSVIEVIPWPLNVHYAASKGGMKLMTKTLALEYAPKGIRVNNIGPGAINTTRNAERWADPKQKADVESMIPMGYIGEPEEIAAVAAWLASKEASYVTGITLFADGGMTLGPSFQAGRG

SEQ ID NO: 859 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtctgtaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgatcgaagacattccttggccgttacgcgtccactatgccgcaagtaaaggcgggatgaagctgatgacaaaaacattagcgttggaatacgcgccgaagggcattcgcgtcaataatattgggccaggtgcgatcaacacgacgggtaacgctcaccgctgggctgaccctaaacagaaagctgatgtagaaagcatgattccaatgggatatattggcgaaccggaggagatcgccgcagtagcagcctggcttgcttcgaaggaagccagctacgtcacaggcatcacgttattcgcggacggcggtatgacagcccgcccttcattcgaggcaggccgcggt

SEQ ID NO: 860 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNLVKEEVIKAGGEAVVVQGDVTKEEDVKNIVQTAIKEFGTLDIMINNAGVCNPVPSHEMPLKDWDKVIATNLTGAFLGSREAIKYFVENDIKGNVINMSSVIEDIPWPLRVHYAASKGGMKLMTKTLALEYAPKGIRVNNIGPGAINTTGNAHRWADPKQKADVESMIPMGYIGEPEEIAAVAAWLASKEASYVTGITLFADGGMTARPSFEAGRG

SEQ ID NO: 861 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtctgtaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgatcgaagtgattccttggccgttaaacgtccactatgccgcaagtaaaggcgggatgaagctgatgacaaaaacattagcgttggaatacgcgccgaagggcattcgcgtcaataatattgggccaggtgcgatcaacacgacgggtaacgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacaacccgcccttcattccaggcaggccgcggt

SEQ ID NO: 862 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNLVKEEVIKAGGEAVVVQGDVTKEEDVKNIVQTAIKEFGTLDIMINNAGVCNPVPSHEMPLKDWDKVIATNLTGAFLGSREAIKYFVENDIKGNVINMSSVIEVIPWPLNVHYAASKGGMKLMTKTLALEYAPKGIRVNNIGPGAINTTGNAERWADPKQKADVESMIPMGYIGEPEEIAAVAAWLASKEASYVTGITLFADGGMTTRPSFQAGRG

SEQ ID NO: 863 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaataagcaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtctgtaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgattgaagaaattccttggccgttaaacgtccactatgccgcaagtaaaggcgggatgaagctgatgacaaaaacattagcgttggaatacgcgccgaagggcattcgcgtcaataatattgggccaggtgcgatcaacacgacgaataatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgagtccttcattccaggcaggccgcggt

SEQ ID NO: 864 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNLVKEEVIKAGGEAVVVQGDVTKEEDVKNIVQTAIKEFGTLDIMINNAGVCNPVPSHEMPLKDWDKVIATNLTGAFLGSREAIKYFVENDIKGNVINMSSVIEEIPWPLNVHYAASKGGMKLMTKTLALEYAPKGIRVNNIGPGAINTTNNAERWADPKQKADVESMIPMGYIGEPEEIAAVAAWLASKEASYVTGITLFADGGMTLSPSFQAGRG

SEQ ID NO: 865 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcaccttatgccgctcaaggattgggataaagtcatcgctacgaacttaacgggtgcctttttaggaagccgtgaagcgattaaatatttcgtagaaaacgatatcaagggaaatgtcattaacatgtccagtgtgatcgaagtgattccttggccgttacgcgtccactatgccgcaagtaaaggcgggatgaagctgatgacaaaaacattagcgttggaatacgcgccgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgagtccttcattccaggcaggccgcggt

SEQ ID NO: 866 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNLVKEEVIKAGGEAVVVQGDVTKEEDVKNIVQTAIKEFGTLDIMINNAGVENPVPSHLMPLKDWDKVIATNLTGAFLGSREAIKYFVENDIKGNVINMSSVIEVIPWPLRVHYAASKGGMKLMTKTLALEYAPKGIRVNNIGPGAINTTGNAERWADPKQKADVESMIPMGYIGEPEEIAAVAAWLASKEASYVTGITLFADGGMTLSPSFQAGRG

SEQ ID NO: 867 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccgctgtcgaaaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgatcgaagtgattccttggccgttacgcgtccactatgccgcaagtaaaggcgggatgaagctgatgacaaaaacattagcgttggaatacgcgccgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgagtccttcattccaggcaggccgcggt

SEQ ID NO: 868 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNLVKEEVIKAGGEAVVVQGDVTKEEDVKNIVQTAIKEFGTLDIMINNAAVENPVPSHEMPLKDWDKVIATNLTGAFLGSREAIKYFVENDIKGNVINMSSVIEVIPWPLRVHYAASKGGMKLMTKTLALEYAPKGIRVNNIGPGAINTTGNAERWADPKQKADVESMIPMGYIGEPEEIAAVAAWLASKEASYVTGITLFADGGMTLSPSFQAGRG

SEQ ID NO: 869 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtggcggaagtgattccttggccgttacgcgtccactatgccgcaagtaaaggcgggatgaagctgatgacaaaaacattagcgttggaatacgcgccgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgagtccttcattccaggcaggccgcggt

SEQ ID NO: 870 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNLVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVAEVIPWPLRVHYAASKGGMKLMTKTLALEYAPKGIRVNNIGPGAINTTGNAERWADPKQKADVESMIPMGYIGEPEEIAAVAAWLASKEASYVTGITLFADGGMTLSPSFQAGRG

SEQ ID NO: 871 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgatcgaagtgattccttggccgttacgcgtccactatgccgcaagtaaaggcgggatgaagctgatgacaaaaacattagcgttggaatacgcgccgaagggcattcgcgtcaataatattgggccaggtgcgatcaacacgacgggtaatgctgagcgctgggctgaccctaaagagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgagtccttcattccaggcaggccgcggt

SEQ ID NO: 872 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNLVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVIEVIPWPLRVHYAASKGGMKLMTKTLALEYAPKGIRVNNIGPGAINTTGNAERWADPKEKADVESMIPMGYIGEPEEIAAVAAWLASKEASYVTGITLFADGGMTLSPSFQAGRG

SEQ ID NO: 873 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgccacgaacttaacgggtgcctttttaggaagccgtgaagcgattaaatatttcgtagaaaacgatatcaagggaaatgtcattaacatgtccagtgtgatcgaagtgattccttggccgttacgcgtccactatgccgcaagtaaaggcgggatgaagctgatgacaaaaacattagcgttggaatacgcgccgaagggcattcgcgtcaataatattgggccaggtgcgatcaacacgacgggtaacgctcaccgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgagcccttcaatccaggcaggccgcggt

SEQ ID NO: 874 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNLVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVIEVIPWPLRVHYAASKGGMKLMTKTLALEYAPKGIRVNNIGPGAINTTGNAHRWADPKQKADVESMIPMGYIGEPEEIAAVAAWLASKEASYVTGITLFADGGMTLSPSIQAGRG

SEQ ID NO: 875 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgatcgaagtgattccttggccgttacgcgtccactatgccgcaagtaaaggcgggatgaagctgatgacaaaaacattagcgttggaatacgcgccgaagggcattcgcgtcaataatattgggccaggtgcgatcaacacgacgggtgctgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgagtccttcattccaggcaggccgcggt

SEQ ID NO: 876 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNLVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVIEVIPWPLRVHYAASKGGMKLMTKTLALEYAPKGIRVNNIGPGAINTTGAAERWADPKQKADVESMIPMGYIGEPEEIAAVAAWLASKEASYVTGITLFADGGMTLSPSFQAGRG

SEQ ID NO: 877 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgcgtgaagtgattccttggccgttacgcgtccactatgccgcaagtaaaggcgggatgaagctgatgacaaaaacattagcgttggaatacgcgccgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgattctgagtccttcattccaggcaggccgcggt

SEQ ID NO: 878 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNLVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREVIPWPLRVHYAASKGGMKLMTKTLALEYAPKGIRVNNIGPGAINTTGNAERWADPKQKADVESMIPMGYIGEPEEIAAVAAWLASKEASYVTGITLFADGGMILSPSFQAGRG

SEQ ID NO: 879 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgcgtgaagtgattccttggccgttacgcgtccactatgccgcaagtaaaggcgggatgaagctgatgacaaaaacattagcgttggaatacgcgccgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgctgctgagtccttcattccaggcaggccgcggt

SEQ ID NO: 880 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNLVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREVIPWPLRVHYAASKGGMKLMTKTLALEYAPKGIRVNNIGPGAINTTGNAERWADPKQKADVESMIPMGYIGEPEEIAAVAAWLASKEASYVTGITLFADGGMLLSPSFQAGRG

SEQ ID NO: 881 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagaaattccttggccgttacgcgtccactatgccgcaagtaaaggcgggatgaagctgatgacaaaaacattagcgttggaatacgcgccgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgagtccttcattccaggcaggccgcggt

SEQ ID NO: 882 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNLVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREEIPWPLRVHYAASKGGMKLMTKTLALEYAPKGIRVNNIGPGAINTTGNAERWADPKQKADVESMIPMGYIGEPEEIAAVAAWLASKEASYVTGITLFADGGMTLSPSFQAGRG

SEQ ID NO: 883 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgcgcgatggccattcgcttcggcaaggagcaggcaaaagtggttatcaactattatagtaataaacaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtaattccttggccgttacgtgtccactatgccgcaagtaaaggcgggatgaagctgatgacaaaaacattagcgttggaatacgcgtcgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatggccctgagtccttcaatttgggcaggccgcggt

SEQ ID NO: 884 - protein, 261 aa, Artificial Sequence
  Variant of Glucose Dehydrogenase from Bacillus subtilis
MYPDLKGKVVAITGAATGLGRAMAIRFGKEQAKVVINYYSNKQDPNAVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREVIPWPLRVHYAASKGGMKLMTKTLALEYASKGIRVNNIGPGAINTTGNAERWADPKQKADVESMIPMGYIGEPEEIAAVAAWLASKEASYVTGITLFADGGMALSPSIWAGRG

SEQ ID NO: 885 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgggacgaacttaacgggtgcctttttaggaagccgtgaagcgattaaatatttcgtagaaaacgatatcaagggaaatgtcattaacatgtccagtgtgcgtgaagaaattccttggccgttacgcgtccactatgccgcaagtaaaggcgggatgaagctgatgacaaaaacattagcgttggaatacgcgtcgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgaccctgagtccttcaattgaggcaggccgcggt

SEQ ID NO: 886 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNLVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVREEIPWPLRVHYAASKGGMKLMTKTLALEYASKGIRVNNIGPGAINTTGNAERWADPKQKADVESMIPMGYIGEPEEIAAVAAWLASKEASYVTGITLFADGGMTLSPSIEAGRG

SEQ ID NO: 887 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaataagcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgggacgaacttaacgggtgcctttttaggaagccgtgaagcgattaaatatttcgtagaaaacgatatcaagggaaatgtcattaacatgtccagtgtgcgtgaagaaattccttggccgttacgcgtccactatgccgcaagtaaaggcgggatgaagctgatgacaaaaacattagcgttggaatacgcgtcgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatggccctgagtccttcatttcaggcaggccgcggt

SEQ ID NO: 888 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNAVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVREEIPWPLRVHYAASKGGMKLMTKTLALEYASKGIRVNNIGPGAINTTGNAERWADPKQKADVESMIPMGYIGEPEEIAAVAAWLASKEASYVTGITLFADGGMALSPSFQAGRG

SEQ ID NO: 889 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgttacgtgtccactatgccgcaagtaaaggcgggatgaagctgatgacaaaaacattagcgttggaatacgcgccgaatggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgaccctgagtccttcaattgaggcaggccgcggt

SEQ ID NO: 890 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNLVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREVIPWPLRVHYAASKGGMKLMTKTLALEYAPNGIRVNNIGPGAINTTGNAERWADPKQKADVESMIPMGYIGEPEEIAAVAAWLASKEASYVTGITLFADGGMTLSPSIEAGRG

SEQ ID NO: 891 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgttaaacgtccactatgccgcaagtaaaggcgggatgaagctgatgacaaaaacattagcgttggaatacgcgccgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgaccctgagtccttcaattgaggcaggccgcggt

SEQ ID NO: 892 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNLVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREVIPWPLNVHYAASKGGMKLMTKTLALEYAPKGIRVNNIGPGAINTTGNAERWADPKQKADVESMIPMGYIGEPEEIAAVAAWLASKEASYVTGITLFADGGMTLSPSIEAGRG

SEQ ID NO: 893 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgcgcgatggccattcgcttcggcaaggagcaggcaaaagtggttatcaactattatagtaataaacaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgcgtgaagaaattccttggccgttacgcgtccactatgccgcaagtaaaggcgggatgaagctgatgacaaaaacattagcgttggaatacgcgccgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgaccctgagtccttcatttgaggcaggccgcggt

SEQ ID NO: 894 - protein, 261 aa, Artificial Sequence
  Variant of Glucose Dehydrogenase from Bacillus subtilis
MYPDLKGKVVAITGAATGLGRAMAIRFGKEQAKVVINYYSNKQDPNAVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREEIPWPLRVHYAASKGGMKLMTKTLALEYAPKGIRVNNIGPGAINTTGNAERWADPKQKADVESMIPMGYIGEPEEIAAVAAWLASKEASYVTGITLFADGGMTLSPSFEAGRG

SEQ ID NO: 895 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaataagcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgcgtgaagtgattccttggccgttacgcgtccactatgccgcaagtaaaggcgggatgaagctgatgacaaaaacattagcgttggaatacgcgtcgaagggcattcgcgtcaataatattgggccaggtgcgatcaacacgacgggtaatgctgagcgctgggctgaccctaaacagaaagctgatgtagaaagcatgattccgatgggatatatcggcgaaccggaggagatcgccgcagtagcagcctggcttgcttcgaaggaagccagctacgtcacaggcatcacgttattcgcggacggcggtatggccctgagtccttcatttgaggcaggccgcggt

SEQ ID NO: 896 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNAVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREVIPWPLRVHYAASKGGMKLMTKTLALEYASKGIRVNNIGPGAINTTGNAERWADPKQKADVESMIPMGYIGEPEEIAAVAAWLASKEASYVTGITLFADGGMALSPSFEAGRG

SEQ ID NO: 897 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgcgtgaagtgattccttggccgttaaacgtccactatgccgcaagtaaaggcgggatgaagctgatgacaaaaacattagcgttggaatacgcgccgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgagtccttcattccaggcaggccgcggt

SEQ ID NO: 898 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNLVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREVIPWPLNVHYAASKGGMKLMTKTLALEYAPKGIRVNNIGPGAINTTGNAERWADPKQKADVESMIPMGYIGEPEEIAAVAAWLASKEASYVTGITLFADGGMTLSPSFQAGRG

SEQ ID NO: 899 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgcgcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgcaaatcctgtgccatctcacgaaatgccgctcaaggattgggataaagtcatcgggacgaacttaacgggtgcctttttaggaagccgtgaagcgattaaatatttcgtagaaaacgatatcaagggaaatgtcattaacatgtccagtgtgcgtgaagtgattccttggccgttaaacgtccactatgccgcaagtaaaggcgggatgaagctgatgacaaaaacattagcgttggaatacgcgtcgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgagtccttcattccaggcaggccgcggt

SEQ ID NO: 900 - protein, 261 aa, Artificial Sequence
  Variant of Glucose Dehydrogenase from Bacillus subtilis
MYPDLKGKVVAITGAATGLGRAMAIRFGKEQAKVVINYYSNKQDPNLVKEEVIKAGGEAVVVQGDVTKEEDVKNIVQTAIKEFGTLDIMINNAGVANPVPSHEMPLKDWDKVIGTNLTGAFLGSREAIKYFVENDIKGNVINMSSVREVIPWPLNVHYAASKGGMKLMTKTLALEYASKGIRVNNIGPGAINTTGNAERWADPKQKADVESMIPMGYIGEPEEIAAVAAWLASKEASYVTGITLFADGGMTLSPSFQAGRG

SEQ ID NO: 901 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaataaacaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgcgtgaagtaattccttggccgttacgtgtccactatgccgcaagtaaaggcgggatgaagctgatgacaaaaacattagcgttggaatacgcgtcgaatggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatggccctgagtccttcatttgaggcaggccgcggt

SEQ ID NO: 902 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNAVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREVIPWPLRVHYAASKGGMKLMTKTLALEYASNGIRVNNIGPGAINTTGNAERWADPKQKADVESMIPMGYIGEPEEIAAVAAWLASKEASYVTGITLFADGGMALSPSFEAGRG

SEQ ID NO: 903 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgcgcgatggccattcgcttcggcaaggagcaggcaaaagtggttatcaactattatagtaataaacaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgcgtgaagtgattccttggccgttacgtgtccactatgccgcaagtaaaggcgggatgaagctgatgacaaaaacattagcgttggaatacgcgtcgaagggcattcgcgtcaataatattgggccaggtgcgatcaacacgacgggtaatgctgagcgctgggctgaccctaaacagaaagctgatgtggaaagcatgattccgatgggatatatcggcgaaccggaggagatcgccgcagtagcagcctggcttgcttcgaaggaagccagctacgtcacaggcatcacgttattcgcggacggcggtatgacactgagtccttcattccaggcaggccgcggt

SEQ ID NO: 904 - protein, 261 aa, Artificial Sequence
  Variant of Glucose Dehydrogenase from Bacillus subtilis
MYPDLKGKVVAITGAATGLGRAMAIRFGKEQAKVVINYYSNKQDPNAVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREVIPWPLRVHYAASKGGMKLMTKTLALEYASKGIRVNNIGPGAINTTGNAERWADPKQKADVESMIPMGYIGEPEEIAAVAAWLASKEASYVTGITLFADGGMTLSPSFQAGRG

SEQ ID NO: 905 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgcgtgaagaaattccttggccgttacgtgtccactatgccgcaagtaaaggcgggatgaagctgatgacaaaaacattagcgttggaatacgcgccgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgaccctgagtccttcaattgaggcaggccgcggt

SEQ ID NO: 906 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNLVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREEIPWPLRVHYAASKGGMKLMTKTLALEYAPKGIRVNNIGPGAINTTGNAERWADPKQKADVESMIPMGYIGEPEEIAAVAAWLASKEASYVTGITLFADGGMTLSPSIEAGRG

SEQ ID NO: 907 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgcgcgatggccattcgcttcggcaaggagcaggcaaaagtggttatcaactattatagtaataagcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtaattccttggccgttaaacgtccactatgccgcaagtaaaggcgggatgaagctgatgacaaaaacattagcgttggaatacgcgtcgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgaccctgagtccttcatttgaggcaggccgcggt

SEQ ID NO: 908 - protein, 261 aa, Artificial Sequence
  Variant of Glucose Dehydrogenase from Bacillus subtilis
MYPDLKGKVVAITGAATGLGRAMAIRFGKEQAKVVINYYSNKQDPNAVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREVIPWPLNVHYAASKGGMKLMTKTLALEYASKGIRVNNIGPGAINTTGNAERWADPKQKADVESMIPMGYIGEPEEIAAVAAWLASKEASYVTGITLFADGGMTLSPSFEAGRG

SEQ ID NO: 909 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgcgcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgggacgaacttaacgggtgcctttttaggaagccgtgaagcgattaaatatttcgtagaaaacgatatcaagggaaatgtcattaacatgtccagtgtgcgtgaagtgattccttggccgttaaacgtccactatgccgcaagtaaaggcgggatgaagctgatgacaaaaacattagcgttggaatacgcgccgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatggccctgagtccttcatttgaggcaggccgcggt

SEQ ID NO: 910 - protein, 261 aa, Artificial Sequence
  Variant of Glucose Dehydrogenase from Bacillus subtilis
MYPDLKGKVVAITGAATGLGRAMAIRFGKEQAKVVINYYSNKQDPNLVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVREVIPWPLNVHYAASKGGMKLMTKTLALEYAPKGIRVNNIGPGAINTTGNAERWADPKQKADVESMIPMGYIGEPEEIAAVAAWLASKEASYVTGITLFADGGMALSPSFEAGRG

SEQ ID NO: 911 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgcgcgatggccattcgcttcggcaaggagcaggcaaaagtggttatcaactattatagtaataaacaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgcaaatcctgtgccatctcacgaaatgccgctcaaggattgggataaagtcatcgggacgaacttaacgggtgcctttttaggaagccgtgaagcgattaaatatttcgtagaaaacgatatcaagggaaatgtcattaacatgtccagtgtgcgtgaagtgattccttggccgttaaacgtccactatgccgcaagtaaaggcgggatgaagctgatgacaaaaacattagcgttggaatacgcgccgaagggcattcgcgtcaataatattgggccaggtgcgatcaacacgacgggtaatgctgagcgctgggctgaccctaaacagaaagctgatgtggaaagcatgattccgatgggatatatcggcgaaccggaggagatcgccgcagtagcagcctggcttgcttcgaaggaagccagctacgtcacaggcatcacgttattcgcggacggcggtatggccctgagtccttcatttcaggcaggccgcggt

SEQ ID NO: 912 - protein, 261 aa, Artificial Sequence
  Variant of Glucose Dehydrogenase from Bacillus subtilis
MYPDLKGKVVAITGAATGLGRAMAIRFGKEQAKVVINYYSNKQDPNAVKEEVIKAGGEAVVVQGDVTKEEDVKNIVQTAIKEFGTLDIMINNAGVANPVPSHEMPLKDWDKVIGTNLTGAFLGSREAIKYFVENDIKGNVINMSSVREVIPWPLNVHYAASKGGMKLMTKTLALEYAPKGIRVNNIGPGAINTTGNAERWADPKQKADVESMIPMGYIGEPEEIAAVAAWLASKEASYVTGITLFADGGMALSPSFQAGRG

SEQ ID NO: 913 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgttacgtgtccactatgccgcaagtaaaggcgggatgaagctgatgacaaaaacattagcgttggaatacgcgtcgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgagtccttcaattcaggcaggccgcggt

SEQ ID NO: 914 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNLVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREVIPWPLRVHYAASKGGMKLMTKTLALEYASKGIRVNNIGPGAINTTGNAERWADPKQKADVESMIPMGYIGEPEEIAAVAAWLASKEASYVTGITLFADGGMTLSPSIQAGRG

SEQ ID NO: 915 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaataagcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgggacgaacttaacgggtgcctttttaggaagccgtgaagcgattaaatatttcgtagaaaacgatatcaagggaaatgtcattaacatgtccagtgtgcgtgaagtgattccttggccgttacgcgtccactatgccgcaagtaaaggcgggatgaagctgatgacaaaaacattagcgttggaatacgcgtcgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgaccctgagtccttcatttgaggcaggccgcggt

SEQ ID NO: 916 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNAVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVREVIPWPLRVHYAASKGGMKLMTKTLALEYASKGIRVNNIGPGAINTTGNAERWADPKQKADVESMIPMGYIGEPEEIAAVAAWLASKEASYVTGITLFADGGMTLSPSFEAGRG

SEQ ID NO: 917 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaataaacaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgttacgtgtccactatgccgcaagtaaaggcgggatgaagctgatgacaaaaacattagcgttggaatacgcgtcgaagggcattcgcgtcaataatattgggccaggtgcgatcaacacgacgggtaatgctgagcgctgggctgaccctaaacagaaagctgatgtagaaagcatgattccgatgggatatatcggcgaaccggaggagatcgccgcagtagcagcctggcttgcttcgaaggaagccagctacgtcacaggcatcacgttattcgcggacggcggtatgacactgagtccttcattccaggcaggccgcggt

SEQ ID NO: 918 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNAVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREVIPWPLRVHYAASKGGMKLMTKTLALEYASKGIRVNNIGPGAINTTGNAERWADPKQKADVESMIPMGYIGEPEEIAAVAAWLASKEASYVTGITLFADGGMTLSPSFQAGRG

SEQ ID NO: 919 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgcgtgaagtgattccttggccgttaaacgtccactatgccgcaagtaaaggcgggatgaagctgatgacaaaaacattagcgttggaatacgcgtcgaatggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgagtccttcattccaggcaggccgcggt

SEQ ID NO: 920 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNLVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREVIPWPLNVHYAASKGGMKLMTKTLALEYASNGIRVNNIGPGAINTTGNAERWADPKQKADVESMIPMGYIGEPEEIAAVAAWLASKEASYVTGITLFADGGMTLSPSFQAGRG

SEQ ID NO: 921 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagaaattccttggccgttacgcgtccactatgccgcaagtaaaggcgggatgaagctgatgacaaaaacattagcgttggaatacgcgccgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgagtccttcattccaggcaggccgcggt

SEQ ID NO: 922 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNAVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREEIPWPLRVHYAASKGGMKLMTKTLALEYAPKGIRVNNIGPGAINTTGNAERWADPKQKADVESMIPMGYIGEPEEIAAVAAWLASKEASYVTGITLFADGGMTLSPSFQAGRG

SEQ ID NO: 923 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgcgtgaagtgattccttggccgttaaacgtccactatgccgcaagtaaaggcgggatgaagctgatgacaaaaacattagcgttggaatacgcgtcgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgagtccttcattccaggcaggccgcggt

SEQ ID NO: 924 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREVIPWPLNVHYAASKGGMKLMTKTLALEYASKGIRVNNIGPGAINTTGNAERWADPKQKADVESMIPMGYIGEPEEIAAVAAWLASKEASYVTGITLFADGGMTLSPSFQAGRG

SEQ ID NO: 925 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgggacgaacttaacgggtgcctttttaggaagccgtgaagcgattaaatatttcgtagaaaacgatatcaagggaaatgtcattaacatgtccagtgtgcgtgaagtgattccttggccgttacgcgtccactatgccgcaagtaaaggcgggatgaagctgatgacaaaaacattagcgttggaatacgcgccgaagggcattcgcgtcaataatattgggccaggtgcgatcaacacgacgggtaatgctgagcgctgggctgaccctaaacagaaagctgatctggaaagcatgattccgatgggatatatcggcgaaccggaggagatcgccgcagtagcagcctggcttgcttcgaaggaagccagctacgtcacaggcatcacgttattcgcggacggcggtatgaccctgagtccttcaattgaggcaggccgcggt

SEQ ID NO: 926 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNLVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVREVIPWPLRVHYAASKGGMKLMTKTLALEYAPKGIRVNNIGPGAINTTGNAERWADPKQKADLESMIPMGYIGEPEEIAAVAAWLASKEASYVTGITLFADGGMTLSPSIEAGRG

SEQ ID NO: 927 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaataagcaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgggacgaacttaacgggtgcctttttaggaagccgtgaagcgattaaatatttcgtagaaaacgatatcaagggaaatgtcattaacatgtccagtgtgcgtgaagaaattccttggccgttaaacgtccactatgccgcaagtaaaggcgggatgaagctgatgacaaaaacattagcgttggaatacgcgccgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatggcactgagtccttcaattcaggcaggccgcggt

SEQ ID NO: 928 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNLVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVREEIPWPLNVHYAASKGGMKLMTKTLALEYAPKGIRVNNIGPGAINTTGNAERWADPKQKADVESMIPMGYIGEPEEIAAVAAWLASKEASYVTGITLFADGGMALSPSIQAGRG

SEQ ID NO: 929 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgcgcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgcgtgaagtgattccttggccgttaaacgtccactatgccgcaagtaaaggcgggatgaagctgatgacaaaaacattagcgttggaatacgcgtcgaagggcattcgcgtcaataatattgggccaggtgcgatcaacacgacgggtaatgctgagcgctgggctgaccctaaacagaaagctgatctggaaagcatgattccgatgggatatatcggcgaaccggaggagatcgccgcagtagcagcctggcttgcttcgaaggaagccagctacgtcacaggcatcacgttattcgcggacggcggtatgacactgagtccttcaattcaggcaggccgcggt

SEQ ID NO: 930 - protein, 261 aa, Artificial Sequence
  Variant of Glucose Dehydrogenase from Bacillus subtilis
MYPDLKGKVVAITGAATGLGRAMAIRFGKEQAKVVINYYSNKQDPNLVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREVIPWPLNVHYAASKGGMKLMTKTLALEYASKGIRVNNIGPGAINTTGNAERWADPKQKADLESMIPMGYIGEPEEIAAVAAWLASKEASYVTGITLFADGGMTLSPSIQAGRG

SEQ ID NO: 931 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgcgcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgggacgaacttaacgggtgcctttttaggaagccgtgaagcgattaaatatttcgtagaaaacgatatcaagggaaatgtcattaacatgtccagtgtgcgtgaagtgattccttggccgttacgtgtccactatgccgcaagtaaaggcgggatgaagctgatgacaaaaacattagcgttggaatacgcgtcgaatggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgagtccttcattccaggcaggccgcggt

SEQ ID NO: 932 - protein, 261 aa, Artificial Sequence
  Variant of Glucose Dehydrogenase from Bacillus subtilis
MYPDLKGKVVAITGAATGLGRAMAIRFGKEQAKVVINYYSNKQDPNLVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVREVIPWPLRVHYAASKGGMKLMTKTLALEYASNGIRVNNIGPGAINTTGNAERWADPKQKADVESMIPMGYIGEPEEIAAVAAWLASKEASYVTGITLFADGGMTLSPSFQAGRG

SEQ ID NO: 933 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcaccaatcctgtgccatctcacgaaatgccgctcaaggattgggataaagtcatcggtacgaacttaacgggtgcctttttaggaagccgtgaagcgattaaatatttcgtagaaaacgatatcaagggaaatgtcattaacatgtccagtgtgcgtgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgggcaacgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgggtccttcattttgggcaggccgcggt

SEQ ID NO: 934 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNLVKEEVIKAGGEAVVVQGDVTKEEDVKNIVQTAIKEFGTLDIMINNAGVTNPVPSHEMPLKDWDKVIGTNLTGAFLGSREAIKYFVENDIKGNVINMSSVREVIPWPLNVHYAASKGGMKLMTKTLALEYAPKGIRVNNIGPGAINTTGNAERWADPKQKADVESMIPMGYIGEPEEIAAVAAWLASKEASYVTGITLFADGGMTLGPSFWAGRG

SEQ ID NO: 935 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgcgtgaagtgattccttggccgttacgcgtccactatgccgcaagtaaaggcgggatgaagctgatgacaaaaacattagcgttggaatacgcgtcgaagggcattcgcgtcaataatattgggccaggtgcgatcaacacgacgggtaacgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgggtccttcatttcaagcaggccgcggt

SEQ ID NO: 936 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNLVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREVIPWPLRVHYAASKGGMKLMTKTLALEYASKGIRVNNIGPGAINTTGNAERWADPKQKADVESMIPMGYIGEPEEIAAVAAWLASKEASYVTGITLFADGGMTLGPSFQAGRG

SEQ ID NO: 937 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccctgcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgcgtgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgggcaacgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgagtccttcattccaggcaggccgcggt

SEQ ID NO: 938 - protein, 261 aa, Artificial Sequence
  Variant of Glucose Dehydrogenase from Bacillus subtilis
MYPDLKGKVVAITGAATGLGKAMALRFGKEQAKVVINYYSNKQDPNLVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREVIPWPLNVHYAASKGGMKLMTKTLALEYAPKGIRVNNIGPGAINTTGNAERWADPKQKADVESMIPMGYIGEPEEIAAVAAWLASKEASYVTGITLFADGGMTLSPSFQAGRG

SEQ ID NO: 939 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccctgcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgcgtgaagtgattccttggccgttacgcgtccactatgccgcaagtaaaggcgggatgaagctgatgacaaaaacattagcgttggaatacgcgtcgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgagtccttcaattcaagcaggccgcggt

SEQ ID NO: 940 - protein, 261 aa, Artificial Sequence
  Variant of Glucose Dehydrogenase from Bacillus subtilis
MYPDLKGKVVAITGAATGLGKAMALRFGKEQAKVVINYYSNKQDPNLVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREVIPWPLRVHYAASKGGMKLMTKTLALEYASKGIRVNNIGPGAINTTGNAERWADPKQKADVESMIPMGYIGEPEEIAAVAAWLASKEASYVTGITLFADGGMTLSPSIQAGRG

SEQ ID NO: 941 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcggtacgaacttaacgggtgcctttttaggaagccgtgaagcgattaaatatttcgtagaaaacgatatcaagggaaatgtcattaacatgtccagtgtgcgtgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgaacaacgctctgcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgagtccttcaattcaagcaggccgcggt

SEQ ID NO: 942 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNLVKEEVIKAGGEAVVVQGDVTKEEDVKNIVQTAIKEFGTLDIMINNAGVENPVPSHEMPLKDWDKVIGTNLTGAFLGSREAIKYFVENDIKGNVINMSSVREVIPWPLNVHYAASKGGMKLMTKTLALEYAPKGIRVNNIGPGAINTTNNALRWADPKQKADVESMIPMGYIGEPEEIAAVAAWLASKEASYVTGITLFADGGMTLSPSIQAGRG

SEQ ID NO: 943 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcaccaatcctgtgccatctcacgaaatgccgctcaaggattgggataaagtcatcggtacgaacttaacgggtgcctttttaggaagccgtgaagcgattaaatatttcgtagaaaacgatatcaagggaaatgtcattaacatgtccagtgtgcgtgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgggcaacgctctgcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgagtccttcattccaggcaggccgcggt

SEQ ID NO: 944 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNLVKEEVIKAGGEAVVVQGDVTKEEDVKNIVQTAIKEFGTLDIMINNAGVTNPVPSHEMPLKDWDKVIGTNLTGAFLGSREAIKYFVENDIKGNVINMSSVREVIPWPLNVHYAASKGGMKLMTKTLALEYAPKGIRVNNIGPGAINTTGNALRWADPKQKADVESMIPMGYIGEPEEIAAVAAWLASKEASYVTGITLFADGGMTLSPSFQAGRG

SEQ ID NO: 945 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgcgtgaagtgattccttggccgttaaatgtccactatgccgcaagtaaaggcgggatgaagctgatgacaaaaacattagcgttggaatacgcgtcgaagggcattcgcgtcaataatattgggccaggtgcgatcaacacgacgggcaacgctcatcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacaacgggtccttcatttcaagcaggccgcggt

SEQ ID NO: 946 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNLVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREVIPWPLNVHYAASKGGMKLMTKTLALEYASKGIRVNNIGPGAINTTGNAHRWADPKQKADVESMIPMGYIGEPEEIAAVAAWLASKEASYVTGITLFADGGMTTGPSFQAGRG

SEQ ID NO: 947 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcaccaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgcgtgaagtgattccttggccgttacgcgtccactatgccgcaagtaaaggcgggatgaagctgatgacaaaaacattagcgttggaatacgcgccgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgggtccttcatttcaagcaggccgcggt

SEQ ID NO: 948 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNLVKEEVIKAGGEAVVVQGDVTKEEDVKNIVQTAIKEFGTLDIMINNAGVTNPVPSHEMPLKDWDKVIATNLTGAFLGSREAIKYFVENDIKGNVINMSSVREVIPWPLRVHYAASKGGMKLMTKTLALEYAPKGIRVNNIGPGAINTTGNAERWADPKQKADVESMIPMGYIGEPEEIAAVAAWLASKEASYVTGITLFADGGMTLGPSFQAGRG

SEQ ID NO: 949 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgcgtgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgaacaacgctctgcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgagtccttcattccaggcaggccgcggt

SEQ ID NO: 950 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNLVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREVIPWPLNVHYAASKGGMKLMTKTLALEYAPKGIRVNNIGPGAINTTNNALRWADPKQKADVESMIPMGYIGEPEEIAAVAAWLASKEASYVTGITLFADGGMTLSPSFQAGRG

SEQ ID NO: 951 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgcgtgaagtgattccttggccgttacgcgtccactatgccgcaagtaaaggcgggatgaagctgatgacaaaaacattagcgttggaatacgcgccgaagggcattcgcgtcaataatattgggccaggtgcgatcaacacgacgggcaacgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgggtccttcattccaggcaggccgcggt

SEQ ID NO: 952 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNLVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREVIPWPLRVHYAASKGGMKLMTKTLALEYAPKGIRVNNIGPGAINTTGNAERWADPKQKADVESMIPMGYIGEPEEIAAVAAWLASKEASYVTGITLFADGGMTLGPSFQAGRG

SEQ ID NO: 953 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaggcgatggccattcgcttcggcaaggagcaggcaaaagtggttatcaactattatagtaataaacaagatccgaacctggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgagaatcctgtgccatctcacgaaatgccgctcaaggattgggataaagtcatcgctacgaacttaacgggtgcctttttaggaagccgtgaagcgattaaatatttcgtagaaaacgatatcaagggaaatgtcattaacatgtccagtgtgcgtgaagtgattccttggccgttaaatgtccactatgccgcaagtaaaggcgggatgaagctgatgacaaaaacattagcgttggaatacgcgccgaagggcattcgcgtcaataatattgggccaggtgcgatcaacacgacgaacaacgctcatcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgggtccttcaatttgggcaggccgcggt

SEQ ID NO: 954 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNLVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREVIPWPLNVHYAASKGGMKLMTKTLALEYAPKGIRVNNIGPGAINTTNNAHRWADPKQKADVESMIPMGYIGEPEEIAAVAAWLASKEASYVTGITLFADGGMTLGPSIWAGRG

SEQ ID NO: 955 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgcgcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtaattccttggccgttaaacgtccactatgccgcaagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaacagaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgggcccttcatttgaggcaggccgtgag

SEQ ID NO: 956 - protein, 261 aa, Artificial Sequence
  Variant of Glucose Dehydrogenase from Bacillus subtilis
MYPDLKGKVVAITGAATGLGRAMAIRFGKEQAKVVINYYSNTQDPNAVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREVIPWPLNVHYAASKGGMKLMTKTLALEYASNGIRVNNIGPGAINTTGNAERWADPKQKADVESMIPMGYIGEPEEIAAVAAWLASKEASYVTGITLFADGGMTLGPSFEAGRE

SEQ ID NO: 957 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgcgcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagaaattccttggccgttaaacgtccactatgccgcaagtaaaggcgggatgaagctgatgacaaaaacattagcgttggaatacgcgtcgcgtggcattcgcgtcaataatattgggccaggtgcgatcaacacgacgggtaatgctgagcgctgggctgaccctaaacagaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgggcccttcatttgaggcaggccagggg

SEQ ID NO: 958 - protein, 261 aa, Artificial Sequence
  Variant of Glucose Dehydrogenase from Bacillus subtilis
MYPDLKGKVVAITGAATGLGRAMAIRFGKEQAKVVINYYSNTQDPNAVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREEIPWPLNVHYAASKGGMKLMTKTLALEYASRGIRVNNIGPGAINTTGNAERWADPKQKADVESMIPMGYIGEPEEIAAVAAWLASKEASYVTGITLFADGGMTLGPSFEAGQG

SEQ ID NO: 959 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgcgcgatggccattcgcttcggcaaggagcaggcaaaagtggttatcaactattatagtaataagcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtaattccttggccgttaaacgtccactatgccgcaagtaaaggcgggatgaagctgatgacaaaaacattagcgttggaatacgcgtcgaagggcattcgcgtcaataatattgggccaggtgcgatcaacacgacgggtaatgctgagcgctgggctgaccctaaacagaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgggcccttcatttgaggcaggccaggag

SEQ ID NO: 960 - protein, 261 aa, Artificial Sequence
  Variant of Glucose Dehydrogenase from Bacillus subtilis
MYPDLKGKVVAITGAATGLGRAMAIRFGKEQAKVVINYYSNKQDPNAVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREVIPWPLNVHYAASKGGMKLMTKTLALEYASKGIRVNNIGPGAINTTGNAERWADPKQKADVESMIPMGYIGEPEEIAAVAAWLASKEASYVTGITLFADGGMTLGPSFEAGQE

SEQ ID NO: 961 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtaattccttggccgttaaacgtccactatgccgcaagtaaaggcgggatgaagctgatgacaaaaacattagcgttggaatacgcgtcgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgaccctgggcccttcatttgaggcaggccaggag

SEQ ID NO: 962 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREVIPWPLNVHYAASKGGMKLMTKTLALEYASKGIRVNNIGPGAINTTGNAERWADPKQKADVESMIPMGYIGEPEEIAAVAAWLASKEASYVTGITLFADGGMTLGPSFEAGQE

SEQ ID NO: 963 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgtgcgatggccattcgcttcggcaaggagcaggcaaaagtggttatcaactattatagtaataagcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtaattccttggccgttaaacgtccactatgccgcaagtaaaggcgggatgaagctgatgacaaaaacattagcgttggaatacgcgtcgcgtggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgaccctgggcccttcatttgaggcaggccaggag

SEQ ID NO: 964 - protein, 261 aa, Artificial Sequence
  Variant of Glucose Dehydrogenase from Bacillus subtilis
MYPDLKGKVVAITGAATGLGRAMAIRFGKEQAKVVINYYSNKQDPNAVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREVIPWPLNVHYAASKGGMKLMTKTLALEYASRGIRVNNIGPGAINTTGNAERWADPKQKADVESMIPMGYIGEPEEIAAVAAWLASKEASYVTGITLFADGGMTLGPSFEAGQE

SEQ ID NO: 965 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgcgcgatggccattcgcttcggcaaggagcaggcaaaagtggttatcaactattatagtaataagcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagaaattccttggccgttaaacgtccactatgccgcaagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgaccctgggcccttcatttgaggcaggccgtggg

SEQ ID NO: 966 - protein, 261 aa, Artificial Sequence
  Variant of Glucose Dehydrogenase from Bacillus subtilis
MYPDLKGKVVAITGAATGLGRAMAIRFGKEQAKVVINYYSNKQDPNAVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREEIPWPLNVHYAASKGGMKLMTKTLALEYASNGIRVNNIGPGAINTTGNAERWADPKQKADVESMIPMGYIGEPEEIAAVAAWLASKEASYVTGITLFADGGMTLGPSFEAGRG

SEQ ID NO: 967 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgtgcgatggccattcgcttcggcaaggagcaggcaaaagtggttatcaactattatagtaataagcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtaattccttggccgttaaacgtccactatgccgcaagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgaccctgggcccttcatttgaggcaggccagggg

SEQ ID NO: 968 - protein, 261 aa, Artificial Sequence
  Variant of Glucose Dehydrogenase from Bacillus subtilis
MYPDLKGKVVAITGAATGLGRAMAIRFGKEQAKVVINYYSNKQDPNAVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREVIPWPLNVHYAASKGGMKLMTKTLALEYASNGIRVNNIGPGAINTTGNAERWADPKQKADVESMIPMGYIGEPEEIAAVAAWLASKEASYVTGITLFADGGMTLGPSFEAGQG

SEQ ID NO: 969 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaataagcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagaaattccttggccgttaaacgtccactatgccgcaagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgaccctgggcccttcatttgaggcaggccgcggt

SEQ ID NO: 970 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNAVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREEIPWPLNVHYAASKGGMKLMTKTLALEYASNGIRVNNIGPGAINTTGNAERWADPKQKADVESMIPMGYIGEPEEIAAVAAWLASKEASYVTGITLFADGGMTLGPSFEAGRG

SEQ ID NO: 971 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgcgcgatggccattcgcttcggcaaggagcaggcaaaagtggttatcaactattatagtaataagcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagaaattccttggccgttaaacgtccactatgccgcaagtaaaggcgggatgaagctgatgacaaaaacattagcgttggaatacgcgtcgcgtggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgaccctgggcccttcatttgaggcaggccgcggt

SEQ ID NO: 972 - protein, 261 aa, Artificial Sequence
  Variant of Glucose Dehydrogenase from Bacillus subtilis
MYPDLKGKVVAITGAATGLGRAMAIRFGKEQAKVVINYYSNKQDPNAVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREEIPWPLNVHYAASKGGMKLMTKTLALEYASRGIRVNNIGPGAINTTGNAERWADPKQKADVESMIPMGYIGEPEEIAAVAAWLASKEASYVTGITLFADGGMTLGPSFEAGRG

SEQ ID NO: 973 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgcgcgatggccattcgcttcggcaaggagcaggcaaaagtggttatcaactattatagtaataagcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagaaattccttggccgttaaacgtccactatgccgcaagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgaccctgggcccttcatttgaggcaggccaggag

SEQ ID NO: 974 - protein, 261 aa, Artificial Sequence
  Variant of Glucose Dehydrogenase from Bacillus subtilis
MYPDLKGKVVAITGAATGLGRAMAIRFGKEQAKVVINYYSNKQDPNAVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREEIPWPLNVHYAASKGGMKLMTKTLALEYASNGIRVNNIGPGAINTTGNAERWADPKQKADVESMIPMGYIGEPEEIAAVAAWLASKEASYVTGITLFADGGMTLGPSFEAGQE

SEQ ID NO: 975 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgcgcgatggccattcgcttcggcaaggagcaggcaaaagtggttatcaactattatagtaataagcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtaattccttggccgttaaacgtccactatgccgcaagtaaaggcgggatgaagctgatgacaaaaacattagcgttggaatacgcgtcgcgtggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgaccctgggcccttcatttgaggcaggccgtgag

SEQ ID NO: 976 - protein, 261 aa, Artificial Sequence
  Variant of Glucose Dehydrogenase from Bacillus subtilis
MYPDLKGKVVAITGAATGLGRAMAIRFGKEQAKVVINYYSNKQDPNAVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREVIPWPLNVHYAASKGGMKLMTKTLALEYASRGIRVNNIGPGAINTTGNAERWADPKQKADVESMIPMGYIGEPEEIAAVAAWLASKEASYVTGITLFADGGMTLGPSFEAGRE

SEQ ID NO: 977 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaataagcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagaaattccttggccgttaaacgtccactatgccgcaagtaaaggcgggatgaagctgatgacaaaaacattagcgttggaatacgcgtcgcgtggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgaccctgggcccttcatttgaggcaggccaggag

SEQ ID NO: 978 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNAVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREEIPWPLNVHYAASKGGMKLMTKTLALEYASRGIRVNNIGPGAINTTGNAERWADPKQKADVESMIPMGYIGEPEEIAAVAAWLASKEASYVTGITLFADGGMTLGPSFEAGQE

SEQ ID NO: 979 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgtgcgatggccattcgcttcggcaaggagcaggcaaaagtggttatcaactattatagtaataagcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtaattccttggccgttaaacgtccactatgccgcaagtaaaggcgggatgaagctgatgacaaaaacattagcgttggaatacgcgtcgcgtggcattcgcgtcaataatattgggccaggtgcgatcaacacgacgggtaatgctgagcgctgggctgaccctaaacagaaagctgatgtagaaagcatgattgcgatgggatatatcggcgaaccggaggagatcgccgcagtagcagcctggcttgcttcgaaggaagccagctacgtcacaggcatcacgttattcgcggacggcggtatgaccctgggcccttcatttgaggcaggccgcggt

SEQ ID NO: 980 - protein, 261 aa, Artificial Sequence
  Variant of Glucose Dehydrogenase from Bacillus subtilis
MYPDLKGKVVAITGAATGLGRAMAIRFGKEQAKVVINYYSNKQDPNAVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREVIPWPLNVHYAASKGGMKLMTKTLALEYASRGIRVNNIGPGAINTTGNAERWADPKQKADVESMIAMGYIGEPEEIAAVAAWLASKEASYVTGITLFADGGMTLGPSFEAGRG

SEQ ID NO: 981 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaataagcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtaattccttggccgttaaacgtccactatgccgcaagtaaaggcgggatgaagctgatgacaaaaacattagcgttggaatacgcgtcgcgtggcattcgcgtcaataatattgggccaggtgcgatcaacacgacgggtaatgctgagcgctgggctgaccctaaacagaaagctgatgtagaaagcatgattgcgatgggatatatcggcgaaccggaggagatcgccgcagtagcagcctggcttgcttcgaaggaagccagctacgtcacaggcatcacgttattcgcggacggcggtatgaccctgggcccttcatttgaggcaggccgcggt

SEQ ID NO: 982 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNAVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREVIPWPLNVHYAASKGGMKLMTKTLALEYASRGIRVNNIGPGAINTTGNAERWADPKQKADVESMIAMGYIGEPEEIAAVAAWLASKEASYVTGITLFADGGMTLGPSFEAGRG

SEQ ID NO: 983 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgtgcgatggccattcgcttcggcaaggagcaggcaaaagtggttatcaactattatagtaataagcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagaaattccttggccgttaaacgtccactatgccgcaagtaaaggcgggatgaagctgatgacaaaaacattagcgttggaatacgcgtcgaaaggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgaccctgggcccttcatttgaggcaggccgcggt

SEQ ID NO: 984 - protein, 261 aa, Artificial Sequence
  Variant of Glucose Dehydrogenase from Bacillus subtilis
MYPDLKGKVVAITGAATGLGRAMAIRFGKEQAKVVINYYSNKQDPNAVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREEIPWPLNVHYAASKGGMKLMTKTLALEYASKGIRVNNIGPGAINTTGNAERWADPKQKADVESMIPMGYIGEPEEIAAVAAWLASKEASYVTGITLFADGGMTLGPSFEAGRG

SEQ ID NO: 985 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgcgcgatggccattcgcttcggcaaggagcaggcaaaagtggttatcaactattatagtaataagcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagaaattccttggccgttaaacgtccactatgccgcaagtaaaggcgggatgaagctgatgacaaaaacattagcgttggaatacgcgtcgcgtggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgaccctgagcccttcatttgaggcaggccaggag

SEQ ID NO: 986 - protein, 261 aa, Artificial Sequence
  Variant of Glucose Dehydrogenase from Bacillus subtilis
MYPDLKGKVVAITGAATGLGRAMAIRFGKEQAKVVINYYSNKQDPNAVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREEIPWPLNVHYAASKGGMKLMTKTLALEYASRGIRVNNIGPGAINTTGNAERWADPKQKADVESMIPMGYIGEPEEIAAVAAWLASKEASYVTGITLFADGGMTLSPSFEAGQE

SEQ ID NO: 987 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgtgcgatggccattcgcttcggcaaggagcaggcaaaagtggttatcaactattatagtaataagcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtaattccttggccgttaaacgtccactatgccgcaagtaaaggcgggatgaagctgatgacaaaaacattagcgttggaatacgcgtcgaaaggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgaccctgggcccttcatttgaggcaggccgtgag

SEQ ID NO: 988 - protein, 261 aa, Artificial Sequence
  Variant of Glucose Dehydrogenase from Bacillus subtilis
MYPDLKGKVVAITGAATGLGRAMAIRFGKEQAKVVINYYSNKQDPNAVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREVIPWPLNVHYAASKGGMKLMTKTLALEYASKGIRVNNIGPGAINTTGNAERWADPKQKADVESMIPMGYIGEPEEIAAVAAWLASKEASYVTGITLFADGGMTLGPSFEAGRE

SEQ ID NO: 989 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgtgcgatggccattcgcttcggcaaggagcaggcaaaagtggttatcaactattatagtaataagcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtaattccttggccgttaaacgtccactatgccgcaagtaaaggcgggatgaagctgatgacaaaaacattagcgttggaatacgcgtcgcgtggcattcgcgtcaataatattgggccaggtgcgatcaacacgacgggtaatgctgagcgctgggctgaccctaaacagaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgggcccttcatttgaggcaggccagggg

SEQ ID NO: 990 - protein, 261 aa, Artificial Sequence
  Variant of Glucose Dehydrogenase from Bacillus subtilis
MYPDLKGKVVAITGAATGLGRAMAIRFGKEQAKVVINYYSNKQDPNAVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREVIPWPLNVHYAASKGGMKLMTKTLALEYASRGIRVNNIGPGAINTTGNAERWADPKQKADVESMIPMGYIGEPEEIAAVAAWLASKEASYVTGITLFADGGMTLGPSFEAGQG

SEQ ID NO: 991 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgcgcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagaaattccttggccgttaaacgtccactatgccgcaagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgaccctgagtccttcatttgaggcaggccaggag

SEQ ID NO: 992 - protein, 261 aa, Artificial Sequence
  Variant of Glucose Dehydrogenase from Bacillus subtilis
MYPDLKGKVVAITGAATGLGRAMAIRFGKEQAKVVINYYSNTQDPNAVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREEIPWPLNVHYAASKGGMKLMTKTLALEYASNGIRVNNIGPGAINTTGNAERWADPKQKADVESMIPMGYIGEPEEIAAVAAWLASKEASYVTGITLFADGGMTLSPSFEAGQE

SEQ ID NO: 993 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgtgcgatggccattcgcttcggcaaggagcaggcaaaagtggttatcaactattatagtaataagcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtaattccttggccgttaaacgtccactatgccgcaagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaacagaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgggcccttcatttgaggcaggccgcggt

SEQ ID NO: 994 - protein, 261 aa, Artificial Sequence
  Variant of Glucose Dehydrogenase from Bacillus subtilis
MYPDLKGKVVAITGAATGLGRAMAIRFGKEQAKVVINYYSNKQDPNAVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREVIPWPLNVHYAASKGGMKLMTKTLALEYASNGIRVNNIGPGAINTTGNAERWADPKQKADVESMIPMGYIGEPEEIAAVAAWLASKEASYVTGITLFADGGMTLGPSFEAGRG

SEQ ID NO: 995 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaataagcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtaattccttggccgttaaacgtccactatgccgcaagtaaaggcgggatgaagctgatgacaaaaacattagcgttggaatacgcgtcgcgtggcattcgcgtcaataatattgggccaggtgcgatcaacacgacgggtaatgctgagcgctgggctgaccctaaacagaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgggcccttcatttgaggcaggccgtggg

SEQ ID NO: 996 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNAVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREVIPWPLNVHYAASKGGMKLMTKTLALEYASRGIRVNNIGPGAINTTGNAERWADPKQKADVESMIPMGYIGEPEEIAAVAAWLASKEASYVTGITLFADGGMTLGPSFEAGRG

SEQ ID NO: 997 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgcgcgatggccattcgcttcggcaaggagcaggcaaaagtggttatcaactattatagtaataagcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaacttccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtaattccttggccgttaaacgtccactatgccgcaagtaaaggcgggatgaagctgatgacaaaaacattagcgttggaatacgcgtcgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgaccctgagtccttcatttgaggcaggccgcggt

SEQ ID NO: 998 - protein, 261 aa, Artificial Sequence
  Variant of Glucose Dehydrogenase from Bacillus subtilis
MYPDLKGKVVAITGAATGLGRAMAIRFGKEQAKVVINYYSNKQDPNAVKEEVIKAGGEAVVVQGDVTKEEDVKNIVQTAIKEFGTLDIMINNAGVENPVPSHELPLKDWDKVIATNLTGAFLGSREAIKYFVENDIKGNVINMSSVREVIPWPLNVHYAASKGGMKLMTKTLALEYASKGIRVNNIGPGAINTTGNAERWADPKQKADVESMIPMGYIGEPEEIAAVAAWLASKEASYVTGITLFADGGMTLSPSFEAGRG

SEQ ID NO: 999 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaataagcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtaattccttggccgttaaacgtccactatgccgcaagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgaccctgggcccttcatttgaggcaggccgcggt

SEQ ID NO: 1000 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNAVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREVIPWPLNVHYAASKGGMKLMTKTLALEYASNGIRVNNIGPGAINTTGNAERWADPKQKADVESMIPMGYIGEPEEIAAVAAWLASKEASYVTGITLFADGGMTLGPSFEAGRG

SEQ ID NO: 1001 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaataagcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtaattccttggccgttaaacgtccactatgccgcaagtaaaggcgggatgaagctgatgacaaaaacattagcgttggaatacgcgtcgaagggcattcgcgtcaataatattgggccaggtgcgatcaacacgacgggtaatgctgagcgctgggctgaccctaaacagaaagctgatgtagaaagcatgattgcgatgggatatatcggcgaaccggaggagatcgccgcagtagcagcctggcttgcttcgaaggaagccagctacgtcacaggcatcacgttattcgcggacggcggtatgaccctgggcccttcatttgaggcaggccgcggt

SEQ ID NO: 1002 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNAVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREVIPWPLNVHYAASKGGMKLMTKTLALEYASKGIRVNNIGPGAINTTGNAERWADPKQKADVESMIAMGYIGEPEEIAAVAAWLASKEASYVTGITLFADGGMTLGPSFEAGRG

SEQ ID NO: 1003 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaataagcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagaaattccttggccgttaaacgtccactatgccgcaagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaacagaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgagtccttcatttgaggcaggccgcggt

SEQ ID NO: 1004 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNAVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREEIPWPLNVHYAASKGGMKLMTKTLALEYASNGIRVNNIGPGAINTTGNAERWADPKQKADVESMIPMGYIGEPEEIAAVAAWLASKEASYVTGITLFADGGMTLSPSFEAGRG

SEQ ID NO: 1005 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgtgcgatggccattcgcttcggcaaggagcaggcaaaagtggttatcaactattatagtaataagcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagaaattccttggccgttaaacgtccactatgccgcaagtaaaggcgggatgaagctgatgacaaaaacattagcgttggaatacgcgtcgcgtggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgaccctgagtccttcatttgaggcaggccagggg

SEQ ID NO: 1006 - protein, 261 aa, Artificial Sequence
  Variant of Glucose Dehydrogenase from Bacillus subtilis
MYPDLKGKVVAITGAATGLGRAMAIRFGKEQAKVVINYYSNKQDPNAVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREEIPWPLNVHYAASKGGMKLMTKTLALEYASRGIRVNNIGPGAINTTGNAERWADPKQKADVESMIPMGYIGEPEEIAAVAAWLASKEASYVTGITLFADGGMTLSPSFEAGQG

SEQ ID NO: 1007 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagaaattccttggccgttaaacgtccactatgccgcaagtaaaggcgggatgaagctgatgacaaaaacattagcgttggaatacgcgtcgaagggcattcgcgtcaataatattgggccaggtgcgatcaacacgacgggtaatgctgagcgctgggctgaccctaaacagaaagctgatgtagaaagcatgattgcgatgggatatatcggcgaaccggaggagatcgccgcagtagcagcctggcttgcttcgaaggaagccagctacgtcacaggcatcacgttattcgcggacggcggtatgaccctgggcccttcatttgaggcaggccgcggt

SEQ ID NO: 1008 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREEIPWPLNVHYAASKGGMKLMTKTLALEYASKGIRVNNIGPGAINTTGNAERWADPKQKADVESMIAMGYIGEPEEIAAVAAWLASKEASYVTGITLFADGGMTLGPSFEAGRG

SEQ ID NO: 1009 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgtgcgatggccattcgcttcggcaaggagcaggcaaaagtggttatcaactattatagtaataagcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagaaattccttggccgttaaacgtccactatgccgcaagtaaaggcgggatgaagctgatgacaaaaacattagcgttggaatacgcgtcgcgtggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgaccctgagtccttcatttgaggcaggccgtgag

SEQ ID NO: 1010 - protein, 261 aa, Artificial Sequence
  Variant of Glucose Dehydrogenase from Bacillus subtilis
MYPDLKGKVVAITGAATGLGRAMAIRFGKEQAKVVINYYSNKQDPNAVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREEIPWPLNVHYAASKGGMKLMTKTLALEYASRGIRVNNIGPGAINTTGNAERWADPKQKADVESMIPMGYIGEPEEIAAVAAWLASKEASYVTGITLFADGGMTLSPSFEAGRE

SEQ ID NO: 1011 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgcgcgatggccattcgcttcggcaaggagcaggcaaaagtggttatcaactattatagtaataagcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagaaattccttggccgttaaacgtccactatgccgcaagtaaaggcgggatgaagctgatgacaaaaacattagcgttggaatacgcgtcgcgtggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgaccctgagcccttcatttgaggcaggccgcggt

SEQ ID NO: 1012 - protein, 261 aa, Artificial Sequence
  Variant of Glucose Dehydrogenase from Bacillus subtilis
MYPDLKGKVVAITGAATGLGRAMAIRFGKEQAKVVINYYSNKQDPNAVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREEIPWPLNVHYAASKGGMKLMTKTLALEYASRGIRVNNIGPGAINTTGNAERWADPKQKADVESMIPMGYIGEPEEIAAVAAWLASKEASYVTGITLFADGGMTLSPSFEAGRG

SEQ ID NO: 1013 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaataagcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagaaattccttggccgttaaacgtccactatgccgcaagtaaaggcgggatgaagctgatgacaaaaacattagcgttggaatacgcgtcgaaaggcattcgcgtcaataatattgggccaggtgcgatcaacacgacgggtaatgctgagcgctgggctgaccctaaacagaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgagtccttcatttgaggcaggccaggag

SEQ ID NO: 1014 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNAVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREEIPWPLNVHYAASKGGMKLMTKTLALEYASKGIRVNNIGPGAINTTGNAERWADPKQKADVESMIPMGYIGEPEEIAAVAAWLASKEASYVTGITLFADGGMTLSPSFEAGQE

SEQ ID NO: 1015 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgcgcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtaattccttggccgttaaacgtccactatgccgcaagtaaaggcgggatgaagctgatgacaaaaacattagcgttggaatacgcgtcgaaaggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgaccctgggcccttcatttgaggcaggccgtggg

SEQ ID NO: 1016 - protein, 261 aa, Artificial Sequence
  Variant of Glucose Dehydrogenase from Bacillus subtilis
MYPDLKGKVVAITGAATGLGRAMAIRFGKEQAKVVINYYSNTQDPNAVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREVIPWPLNVHYAASKGGMKLMTKTLALEYASKGIRVNNIGPGAINTTGNAERWADPKQKADVESMIPMGYIGEPEEIAAVAAWLASKEASYVTGITLFADGGMTLGPSFEAGRG

SEQ ID NO: 1017 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgcgcgatggccattcgcttcggcaaggagcaggcaaaagtggttatcaactattatagtaataagcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtaattccttggccgttaaacgtccactatgccgcaagtaaaggcgggatgaagctgatgacaaaaacattagcgttggaatacgcgtcgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgaccctgagtcctccgtttgaggcaggccgcggt

SEQ ID NO: 1018 - protein, 261 aa, Artificial Sequence
  Variant of Glucose Dehydrogenase from Bacillus subtilis
MYPDLKGKVVAITGAATGLGRAMAIRFGKEQAKVVINYYSNKQDPNAVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREVIPWPLNVHYAASKGGMKLMTKTLALEYASKGIRVNNIGPGAINTTGNAERWADPKQKADVESMIPMGYIGEPEEIAAVAAWLASKEASYVTGITLFADGGMTLSPPFEAGRG

SEQ ID NO: 1019 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaataagcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagaaattccttggccgttaaacgtccactatgccgcaagtaaaggcgggatgaagctgatgacaaaaacattagcgttggaatacgcgtcgcgtggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgaccctgagcccttcatttgaggcaggccgtggg

SEQ ID NO: 1020 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNAVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREEIPWPLNVHYAASKGGMKLMTKTLALEYASRGIRVNNIGPGAINTTGNAERWADPKQKADVESMIPMGYIGEPEEIAAVAAWLASKEASYVTGITLFADGGMTLSPSFEAGRG

SEQ ID NO: 1021 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgtgcgatggccattcgcttcggcaaggagcaggcaaaagtggttatcaactattatagtaataagcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtaattccttggccgttaaacgtccactatgccgcaagtaaaggcgggatgaagctgatgacaaaaacattagcgttggaatacgcgtcgcgtggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgaccctgggcccttcatttgaggcaggccgtggg

SEQ ID NO: 1022 - protein, 261 aa, Artificial Sequence
  Variant of Glucose Dehydrogenase from Bacillus subtilis
MYPDLKGKVVAITGAATGLGRAMAIRFGKEQAKVVINYYSNKQDPNAVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREVIPWPLNVHYAASKGGMKLMTKTLALEYASRGIRVNNIGPGAINTTGNAERWADPKQKADVESMIPMGYIGEPEEIAAVAAWLASKEASYVTGITLFADGGMTLGPSFEAGRG

SEQ ID NO: 1023 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgtgcgatggccattcgcttcggcaaggagcaggcaaaagtggttatcaactattatagtaataagcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtaattccttggccgttaaacgtccactatgccgcaagtaaaggcgggatgaagctgatgacaaaaacattagcgttggaatacgcgtcgaagggcattcgcgtcaataatattgggccaggtgcgatcaacacgacgggtaatgctgagcgctgggctgaccctaaacagaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgggcccttcatttgaggcaggccgcggt

SEQ ID NO: 1024 - protein, 261 aa, Artificial Sequence
  Variant of Glucose Dehydrogenase from Bacillus subtilis
MYPDLKGKVVAITGAATGLGRAMAIRFGKEQAKVVINYYSNKQDPNAVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREVIPWPLNVHYAASKGGMKLMTKTLALEYASKGIRVNNIGPGAINTTGNAERWADPKQKADVESMIPMGYIGEPEEIAAVAAWLASKEASYVTGITLFADGGMTLGPSFEAGRG

SEQ ID NO: 1025 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgtgcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagaaattccttggccgttaaacgtccactatgccgcaagtaaaggcgggatgaagctgatgacaaaaacattagcgttggaatacgcgtcgaagggcattcgcgtcaataatattgggccaggtgcgatcaacacgacgggtaatgctgagcgctgggctgaccctaaacagaaagctgatgtagaaagcatgattgcgatgggatatatcggcgaaccggaggagatcgccgcagtagcagcctggcttgcttcgaaggaagccagctacgtcacaggcatcacgttattcgcggacggcggtatgaccctgggcccttcatttgaggcaggccgcggt

SEQ ID NO: 1026 - protein, 261 aa, Artificial Sequence
  Variant of Glucose Dehydrogenase from Bacillus subtilis
MYPDLKGKVVAITGAATGLGRAMAIRFGKEQAKVVINYYSNTQDPNAVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREEIPWPLNVHYAASKGGMKLMTKTLALEYASKGIRVNNIGPGAINTTGNAERWADPKQKADVESMIAMGYIGEPEEIAAVAAWLASKEASYVTGITLFADGGMTLGPSFEAGRG

SEQ ID NO: 1027 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgcgcgatggccattcgcttcggcaaggagcaggcaaaagtggttatcaactattatagtaataagcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggatctggtcatcgcgacgaacttaacgggtgcctttttaggaagccgtgaagcgattaaatatttcgtagaaaacgatatcaagggaaatgtcattaacatgtccagtgtgcgtgaagtaattccttggccgttaaacgtccactatgccgcaagtaaaggcgggatgaagctgatgacaaaaacattagcgttggaatacgcgtcgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgaccctgagtccttcatttgaggcaggccgcggt

SEQ ID NO: 1028 - protein, 261 aa, Artificial Sequence
  Variant of Glucose Dehydrogenase from Bacillus subtilis
MYPDLKGKVVAITGAATGLGRAMAIRFGKEQAKVVINYYSNKQDPNAVKEEVIKAGGEAVVVQGDVTKEEDVKNIVQTAIKEFGTLDIMINNAGVENPVPSHEMPLKDWDLVIATNLTGAFLGSREAIKYFVENDIKGNVINMSSVREVIPWPLNVHYAASKGGMKLMTKTLALEYASKGIRVNNIGPGAINTTGNAERWADPKQKADVESMIPMGYIGEPEEIAAVAAWLASKEASYVTGITLFADGGMTLSPSFEAGRG

SEQ ID NO: 1029 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaataagcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagaaattccttggccgttaaacgtccactatgccgcaagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaacagaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgagtccttcatttgaggcaggccgtgag

SEQ ID NO: 1030 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNAVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREEIPWPLNVHYAASKGGMKLMTKTLALEYASNGIRVNNIGPGAINTTGNAERWADPKQKADVESMIPMGYIGEPEEIAAVAAWLASKEASYVTGITLFADGGMTLSPSFEAGRE

SEQ ID NO: 1031 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaataagcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtaattccttggccgttaaacgtccactatgccgcaagtaaaggcgggatgaagctgatgacaaaaacattagcgttggaatacgcgtcgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgaccctgggcccttcatttgaggcaggccgcggt

SEQ ID NO: 1032 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNAVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREVIPWPLNVHYAASKGGMKLMTKTLALEYASKGIRVNNIGPGAINTTGNAERWADPKQKADVESMIPMGYIGEPEEIAAVAAWLASKEASYVTGITLFADGGMTLGPSFEAGRG

SEQ ID NO: 1033 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgtgcgatggccattcgcttcggcaaggagcaggcaaaagtggttatcaactattatagtaataagcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagaaattccttggccgttaaacgtccactatgccgcaagtaaaggcgggatgaagctgatgacaaaaacattagcgttggaatacgcgtcgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgaccctgagtccttcatttgaggcaggccgtgag

SEQ ID NO: 1034 - protein, 261 aa, Artificial Sequence
  Variant of Glucose Dehydrogenase from Bacillus subtilis
MYPDLKGKVVAITGAATGLGRAMAIRFGKEQAKVVINYYSNKQDPNAVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREEIPWPLNVHYAASKGGMKLMTKTLALEYASKGIRVNNIGPGAINTTGNAERWADPKQKADVESMIPMGYIGEPEEIAAVAAWLASKEASYVTGITLFADGGMTLSPSFEAGRE

SEQ ID NO: 1035 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagaaattccttggccgttaaacgtccactatgccgcaagtaaaggcgggatgaagctgatgacaaaaacattagcgttggaatacgcgtcgaaaggcattcgcgtcaataatattgggccaggtgcgatcaacacgacgggtaatgctgagcgctgggctgaccctaaacagaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgagcccttcatttgaggcaggccgcggt

SEQ ID NO: 1036 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREEIPWPLNVHYAASKGGMKLMTKTLALEYASKGIRVNNIGPGAINTTGNAERWADPKQKADVESMIPMGYIGEPEEIAAVAAWLASKEASYVTGITLFADGGMTLSPSFEAGRG

SEQ ID NO: 1037 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaataagcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagaaattccttggccgttaaacgtccactatgccgcaagtaaaggcgggatgaagctgatgacaaaaacattagcgttggaatacgcgtcgcgtggcattcgcgtcaataatattgggccaggtgcgatcaacacgacgggtaatgctgagcgctgggctgaccctaaacagaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgcgcccttcatttgaggcaggccagggg

SEQ ID NO: 1038 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNAVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREEIPWPLNVHYAASKGGMKLMTKTLALEYASRGIRVNNIGPGAINTTGNAERWADPKQKADVESMIPMGYIGEPEEIAAVAAWLASKEASYVTGITLFADGGMTLRPSFEAGQG

SEQ ID NO: 1039 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaataagcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagaaattccttggccgttaaacgtccactatgccgcaagtaaaggcgggatgaagctgatgacaaaaacattagcgttggaatacgcgtcgaaaggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgaccctgagtccttcatttgaggcaggccgtgag

SEQ ID NO: 1040 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNAVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREEIPWPLNVHYAASKGGMKLMTKTLALEYASKGIRVNNIGPGAINTTGNAERWADPKQKADVESMIPMGYIGEPEEIAAVAAWLASKEASYVTGITLFADGGMTLSPSFEAGRE

SEQ ID NO: 1041 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgcgcgatggccattcgcttcggcaaggagcaggcaaaagtggttatcaactattatacgaataagcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtaattccttggccgttaaacgtccactatgccgcaagtaaaggcgggatgaagctgatgacaaaaacattagcgttggaatacgcgtcgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgaccctgagtccttcatttgaggcaggccgcggt

SEQ ID NO: 1042 - protein, 261 aa, Artificial Sequence
  Variant of Glucose Dehydrogenase from Bacillus subtilis
MYPDLKGKVVAITGAATGLGRAMAIRFGKEQAKVVINYYTNKQDPNAVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREVIPWPLNVHYAASKGGMKLMTKTLALEYASKGIRVNNIGPGAINTTGNAERWADPKQKADVESMIPMGYIGEPEEIAAVAAWLASKEASYVTGITLFADGGMTLSPSFEAGRG

SEQ ID NO: 1043 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtaattccttggccgttaaacgtccactatgccgcaagtaaaggcgggatgaagctgatgacaaaaacattagcgttggaatacgcgtcgcgtggcattcgcgtcaataatattgggccaggtgcgatcaacacgacgggtaatgctgagcgctgggctgaccctaaacagaaagctgatgtagaaagcatgattgcgatgggatatatcggcgaaccggaggagatcgccgcagtagcagcctggcttgcttcgaaggaagccagctacgtcacaggcatcacgtttttcgcggacggcggtatgaccctgggcccttcatttgaggcaggccgcggt

SEQ ID NO: 1044 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREVIPWPLNVHYAASKGGMKLMTKTLALEYASRGIRVNNIGPGAINTTGNAERWADPKQKADVESMIAMGYIGEPEEIAAVAAWLASKEASYVTGITFFADGGMTLGPSFEAGRG

SEQ ID NO: 1045 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgtgcgatggccattcgcttcggcaaggagcaggcaaaagtggttatcaactattatagtaataagcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagaaattccttggccgttaaacgtccactatgccgcaagtaaaggcgggatgaagctgatgacaaaaacattagcgttggaatacgcgtcgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgaccctgagtccttcatttgaggcaggccgcggt

SEQ ID NO: 1046 - protein, 261 aa, Artificial Sequence
  Variant of Glucose Dehydrogenase from Bacillus subtilis
MYPDLKGKVVAITGAATGLGRAMAIRFGKEQAKVVINYYSNKQDPNAVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREEIPWPLNVHYAASKGGMKLMTKTLALEYASKGIRVNNIGPGAINTTGNAERWADPKQKADVESMIPMGYIGEPEEIAAVAAWLASKEASYVTGITLFADGGMTLSPSFEAGRG

SEQ ID NO: 1047 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgcgcgatggccattcgcttcggcaaggagcaggcaaaagtggttatcaactattatagtaataagcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtaattccttggccgttaaacgtccactatgccagtagtaaaggcgggatgaagctgatgacaaaaacattagcgttggaatacgcgtcgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgaccctgagtccttcatttgaggcaggccgcggt

SEQ ID NO: 1048 - protein, 261 aa, Artificial Sequence
  Variant of Glucose Dehydrogenase from Bacillus subtilis
MYPDLKGKVVAITGAATGLGRAMAIRFGKEQAKVVINYYSNKQDPNAVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREVIPWPLNVHYASSKGGMKLMTKTLALEYASKGIRVNNIGPGAINTTGNAERWADPKQKADVESMIPMGYIGEPEEIAAVAAWLASKEASYVTGITLFADGGMTLSPSFEAGRG

SEQ ID NO: 1049 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgcgcgatggccattcgcttcggcaaggagcaggcaaaagtggttatcaactattatagtaataagcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagaaattccttggccgttaaacgtccactatgccgcaagtaaaggcgggatgaagctgatgacaaaaacattagcgttggaatacgcgtcgaaaggcattcgcgtcaataatattgggccaggtgcgatcaacacgacgggtaatgctgagcgctgggctgaccctaaacagaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgcgcccttcatttgaggcaggccgcggt

SEQ ID NO: 1050 - protein, 261 aa, Artificial Sequence
  Variant of Glucose Dehydrogenase from Bacillus subtilis
MYPDLKGKVVAITGAATGLGRAMAIRFGKEQAKVVINYYSNKQDPNAVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREEIPWPLNVHYAASKGGMKLMTKTLALEYASKGIRVNNIGPGAINTTGNAERWADPKQKADVESMIPMGYIGEPEEIAAVAAWLASKEASYVTGITLFADGGMTLRPSFEAGRG

SEQ ID NO: 1051 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaataagcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtaattccttggccgttaaacgtccactatgccgcaagtaaaggcgggatgaagctgatgacaaaaacattagcgttggaatacgcgtcgcgtggcattcgcgtcaataatattgggccaggtgcgatcaacacgacgggtaatgctgagcgctgggctgaccctaaacagaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgagcccttcatttgaggcaggccgtgag

SEQ ID NO: 1052 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNAVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREVIPWPLNVHYAASKGGMKLMTKTLALEYASRGIRVNNIGPGAINTTGNAERWADPKQKADVESMIPMGYIGEPEEIAAVAAWLASKEASYVTGITLFADGGMTLSPSFEAGRE

SEQ ID NO: 1053 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgcgcgatggccattcgcttcggcaaggagcaggcaaaagtggttatcaactattatagtaataagcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtaattccttggccgttaaacgtccactatgccgcaagtaaaggcgggatgaagctgatgacaaaaacattagcgttggaatacgcgctgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgaccctgagtccttcatttgaggcaggccgcggt

SEQ ID NO: 1054 - protein, 261 aa, Artificial Sequence
  Variant of Glucose Dehydrogenase from Bacillus subtilis
MYPDLKGKVVAITGAATGLGRAMAIRFGKEQAKVVINYYSNKQDPNAVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREVIPWPLNVHYAASKGGMKLMTKTLALEYALKGIRVNNIGPGAINTTGNAERWADPKQKADVESMIPMGYIGEPEEIAAVAAWLASKEASYVTGITLFADGGMTLSPSFEAGRG

SEQ ID NO: 1055 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgtgcgatggccattcgcttcggcaaggagcaggcaaaagtggttatcaactattatagtaataagcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtaattccttggccgttaaacgtccactatgccgcaagtaaaggcgggatgaagctgatgacaaaaacattagcgttggaatacgcgtcgcgtggcattcgcgtcaataatattgggccaggtgcgatcaacacgacgggtaatgctgagcgctgggctgaccctaaacagaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgagtccttcatttgaggcaggccgtgag

SEQ ID NO: 1056 - protein, 261 aa, Artificial Sequence
  Variant of Glucose Dehydrogenase from Bacillus subtilis
MYPDLKGKVVAITGAATGLGRAMAIRFGKEQAKVVINYYSNKQDPNAVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREVIPWPLNVHYAASKGGMKLMTKTLALEYASRGIRVNNIGPGAINTTGNAERWADPKQKADVESMIPMGYIGEPEEIAAVAAWLASKEASYVTGITLFADGGMTLSPSFEAGRE

SEQ ID NO: 1057 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaataagcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagaaattccttggccgttaaacgtccactatgccgcaagtaaaggcgggatgaagctgatgacaaaaacattagcgttggaatacgcgtcgaagggcattcgcgtcaataatattgggccaggtgcgatcaacacgacgggtaatgctgagcgctgggctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgaccctgagcccttcatttgaggcaggccgtggg

SEQ ID NO: 1058 - protein, 261 aa, Artificial Sequence
  Variant of Glucose Dehydrogenase from Bacillus subtilis
MYPDLKGKVVAITGAATGLGKAMAIRFGKEQAKVVINYYSNKQDPNAVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREEIPWPLNVHYAASKGGMKLMTKTLALEYASKGIRVNNIGPGAINTTGNAERWADPKQKADVESMIPMGYIGEPEEIAAVAAWLASKEASYVTGITLFADGGMTLSPSFEAGRG

SEQ ID NO: 1059 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgtgcgatggccattcgcttcggcaaggagcaggcaaaagtggttatcaactattatagtaataagcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtaattccttggccgttaaacgtccactatgccgcaagtaaaggcgggatgaagctgatgacaaaaacattagcgttggaatacgcgtcgcgtggcattcgcgtcaataatattgggccaggtgcgatcaacacgacgggtaatgctgagcgctgggctgaccctaaacagaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgagcccttcatttgaggcaggccaggag

SEQ ID NO: 1060 - protein, 261 aa, Artificial Sequence
  Variant of Glucose Dehydrogenase from Bacillus subtilis
MYPDLKGKVVAITGAATGLGRAMAIRFGKEQAKVVINYYSNKQDPNAVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREVIPWPLNVHYAASKGGMKLMTKTLALEYASRGIRVNNIGPGAINTTGNAERWADPKQKADVESMIPMGYIGEPEEIAAVAAWLASKEASYVTGITLFADGGMTLSPSFEAGQE

SEQ ID NO: 1061 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgttaaacgtccactatgcctcgagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaacagaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgggccctgcgtttgagccaggccgcgag

SEQ ID NO: 1062 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVQGDVTKEEDVKNIVQTAIKEFGTLDIMINNAGVENPVPSHELPLKDWDKVIATNLTGAFLGSREAIKYFVENDIKGNVINMSSVREVIPWPLNVHYASSKGGMKLMTKTLALEYASNGIRVNNIGPGAINTTGNAERWADPKQKADVESMIPMGYIGEPEEIAAVAAWLASKEASYVTGITLFADGGMTLGPAFEPGRE

SEQ ID NO: 1063 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgcgcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtaattccttggccgttaaacgtccactatgcctcgagtaaaggcgggatgaagctgatgacaaaaacattagcgttggaatacgcgtcgcgtggcattcgcgtcaataatattgggccaggtgcgatcaacacgacgggtaatgctgagcgctgggctgaccctaaacagaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgggcccttcatttgaggcaggccgtgag

SEQ ID NO: 1064 - protein, 261 aa, Artificial Sequence
  Variant of Glucose Dehydrogenase from Bacillus subtilis
MYPDLKGKVVAITGAATGLGRAMAIRFGKEQAKVVINYYSNTQDPNAVKEEVIKAGGEAVVVQGDVTKEEDVKNIVQTAIKEFGTLDIMINNAGVENPVPSHELPLKDWDKVIATNLTGAFLGSREAIKYFVENDIKGNVINMSSVREVIPWPLNVHYASSKGGMKLMTKTLALEYASRGIRVNNIGPGAINTTGNAERWADPKQKADVESMIPMGYIGEPEEIAAVAAWLASKEASYVTGITLFADGGMTLGPSFEAGRE

SEQ ID NO: 1065 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgcgcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaggtcatcgcgacgaacttaacgggtgcctttttaggaagccgtgaagcgattaaatatttcgtagaaaacgatatcaagggaaatgtcattaacatgtccagtgtgcgtgaagagattccttggccgttaaacgtccactatgccgcaagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaacagaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgggccctttttttgagccaggccaggag

SEQ ID NO: 1066 - protein, 261 aa, Artificial Sequence
  Variant of Glucose Dehydrogenase from Bacillus subtilis
MYPDLKGKVVAITGAATGLGRAMAIRFGKEQAKVVINYYSNTQDPNAVKEEVIKAGGEAVVVQGDVTKEEDVKNIVQTAIKEFGTLDIMINNAGVENPVPSHELPLKDWDKVIATNLTGAFLGSREAIKYFVENDIKGNVINMSSVREEIPWPLNVHYAASKGGMKLMTKTLALEYASNGIRVNNIGPGAINTTGNAERWADPKQKADVESMIPMGYIGEPEEIAAVAAWLASKEASYVTGITLFADGGMTLGPFFEPGQE

SEQ ID NO: 1067 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgcgcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgttaaacgtccactatgcctcgagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaacagaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgggcccttcatttgaggcaggccgcgag

SEQ ID NO: 1068 - protein, 261 aa, Artificial Sequence
  Variant of Glucose Dehydrogenase from Bacillus subtilis
MYPDLKGKVVAITGAATGLGRAMAIRFGKEQAKVVINYYSNTQDPNAVKEEVIKAGGEAVVVQGDVTKEEDVKNIVQTAIKEFGTLDIMINNAGVENPVPSHELPLKDWDKVIATNLTGAFLGSREAIKYFVENDIKGNVINMSSVREVIPWPLNVHYASSKGGMKLMTKTLALEYASNGIRVNNIGPGAINTTGNAERWADPKQKADVESMIPMGYIGEPEEIAAVAAWLASKEASYVTGITLFADGGMTLGPSFEAGRE

SEQ ID NO: 1069 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgcgcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgttaaacgtccactatgcctcgagtaaaggcgggatgaagctgatgacaaaaacattagcgttggaatacgcgctgaatggcattcgcgtcaataatattgggccaggtgcgatcaacacgacgggtaatgctgagcgctgggctgaccctaaacagaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgggcccttcatttgaggcaggccgtgag

SEQ ID NO: 1070 - protein, 261 aa, Artificial Sequence
  Variant of Glucose Dehydrogenase from Bacillus subtilis
MYPDLKGKVVAITGAATGLGRAMAIRFGKEQAKVVINYYSNTQDPNAVKEEVIKAGGEAVVVQGDVTKEEDVKNIVQTAIKEFGTLDIMINNAGVENPVPSHELPLKDWDKVIATNLTGAFLGSREAIKYFVENDIKGNVINMSSVREVIPWPLNVHYASSKGGMKLMTKTLALEYALNGIRVNNIGPGAINTTGNAERWADPKQKADVESMIPMGYIGEPEEIAAVAAWLASKEASYVTGITLFADGGMTLGPSFEAGRE

SEQ ID NO: 1071 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgcgcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtaattccttggccgttaaacgtccactatgccgcaagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaacagaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgggcccttcgtttgagccaggccaggag

SEQ ID NO: 1072 - protein, 261 aa, Artificial Sequence
  Variant of Glucose Dehydrogenase from Bacillus subtilis
MYPDLKGKVVAITGAATGLGRAMAIRFGKEQAKVVINYYSNTQDPNAVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREVIPWPLNVHYAASKGGMKLMTKTLALEYASNGIRVNNIGPGAINTTGNAERWADPKQKADVESMIPMGYIGEPEEIAAVAAWLASKEASYVTGITLFADGGMTLGPSFEPGQE

SEQ ID NO: 1073 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgcgcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtaattccttggccgaagaacgtccactatgccgcaagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaacagaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgggcccttcatttgaggcaggccgtgag

SEQ ID NO: 1074 - protein, 261 aa, Artificial Sequence
  Variant of Glucose Dehydrogenase from Bacillus subtilis
MYPDLKGKVVAITGAATGLGRAMAIRFGKEQAKVVINYYSNTQDPNAVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREVIPWPKNVHYAASKGGMKLMTKTLALEYASNGIRVNNIGPGAINTTGNAERWADPKQKADVESMIPMGYIGEPEEIAAVAAWLASKEASYVTGITLFADGGMTLGPSFEAGRE

SEQ ID NO: 1075 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgcgcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtaattccttggccgcagaacgtccactatgccgcaagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaacagaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgggcccttcatttgaggcaggccgtgag

SEQ ID NO: 1076 - protein, 261 aa, Artificial Sequence
  Variant of Glucose Dehydrogenase from Bacillus subtilis
MYPDLKGKVVAITGAATGLGRAMAIRFGKEQAKVVINYYSNTQDPNAVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREVIPWPQNVHYAASKGGMKLMTKTLALEYASNGIRVNNIGPGAINTTGNAERWADPKQKADVESMIPMGYIGEPEEIAAVAAWLASKEASYVTGITLFADGGMTLGPSFEAGRE

SEQ ID NO: 1077 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgcgcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtaattccttggccgttaaacgtccactatgccgcaagtaaaggcgggatgaagctgatgacaaaaacattagcggctgaatacgcgtcgaacggcattcgcgtcaataatattgggccaggtgcgatcaacacgacgggtaatgctgagcgctgggctgaccctaaacagaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgggcccttcatttgaggcaggccgtgag

SEQ ID NO: 1078 - protein, 261 aa, Artificial Sequence
  Variant of Glucose Dehydrogenase from Bacillus subtilis
MYPDLKGKVVAITGAATGLGRAMAIRFGKEQAKVVINYYSNTQDPNAVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREVIPWPLNVHYAASKGGMKLMTKTLAAEYASNGIRVNNIGPGAINTTGNAERWADPKQKADVESMIPMGYIGEPEEIAAVAAWLASKEASYVTGITLFADGGMTLGPSFEAGRE

SEQ ID NO: 1079 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgcgcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtaattccttggccgttaaacgtccactatgccgcaagtaaaggcgggatgaagctgatgacaaaaacattagcgttggaatacgcgtcgcgtggcattcgcgtcaataatattgggccaggtgcgatcaacacgacgggtaatgctgagcgctgggctgaccctaaacagaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgggcccttcatttgaggcaggccgtgag

SEQ ID NO: 1080 - protein, 261 aa, Artificial Sequence
  Variant of Glucose Dehydrogenase from Bacillus subtilis
MYPDLKGKVVAITGAATGLGRAMAIRFGKEQAKVVINYYSNTQDPNAVKEEVIKAGGEAVVVQGDVTKEEDVKNIVQTAIKEFGTLDIMINNAGVENPVPSHELPLKDWDKVIATNLTGAFLGSREAIKYFVENDIKGNVINMSSVREVIPWPLNVHYAASKGGMKLMTKTLALEYASRGIRVNNIGPGAINTTGNAERWADPKQKADVESMIPMGYIGEPEEIAAVAAWLASKEASYVTGITLFADGGMTLGPSFEAGRE

SEQ ID NO: 1081 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgcgcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtaattccttggccgttaaacgtccactatgccgcaagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaacagaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgggcccttcatttgagccaggccaggag

SEQ ID NO: 1082 - protein, 261 aa, Artificial Sequence
  Variant of Glucose Dehydrogenase from Bacillus subtilis
MYPDLKGKVVAITGAATGLGRAMAIRFGKEQAKVVINYYSNTQDPNAVKEEVIKAGGEAVVVQGDVTKEEDVKNIVQTAIKEFGTLDIMINNAGVENPVPSHELPLKDWDKVIATNLTGAFLGSREAIKYFVENDIKGNVINMSSVREVIPWPLNVHYAASKGGMKLMTKTLALEYASNGIRVNNIGPGAINTTGNAERWADPKQKADVESMIPMGYIGEPEEIAAVAAWLASKEASYVTGITLFADGGMTLGPSFEPGQE

SEQ ID NO: 1083 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgcgcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgttaaacgtccactatgccgcaagtaaaggcgggatgaagctgatgacaaaaacattagcgttggaatacgcgaagaatggcattcgcgtcaataatattgggccaggtgcgatcaacacgacgggtaatgctgagcgctgggctgaccctaaacagaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgggccctttttttgaggcaggccaggag

SEQ ID NO: 1084 - protein, 261 aa, Artificial Sequence
  Variant of Glucose Dehydrogenase from Bacillus subtilis
MYPDLKGKVVAITGAATGLGRAMAIRFGKEQAKVVINYYSNTQDPNAVKEEVIKAGGEAVVVQGDVTKEEDVKNIVQTAIKEFGTLDIMINNAGVENPVPSHELPLKDWDKVIATNLTGAFLGSREAIKYFVENDIKGNVINMSSVREVIPWPLNVHYAASKGGMKLMTKTLALEYAKNGIRVNNIGPGAINTTGNAERWADPKQKADVESMIPMGYIGEPEEIAAVAAWLASKEASYVTGITLFADGGMTLGPFFEAGQE

SEQ ID NO: 1085 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgcgcgatggccattcgcttcggcaaggagcaggcaaaagtggttatcaactattatactaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtaattccttggccgttaaacgtccactatgccgcaagtaaaggcgggatgaagctgatgacaaaaacattagcgttggaatacgcgcgtcgtggcattcgcgtcaataatattgggccaggtgcgatcaacacgacgggtaatgctgagcgctgggctgaccctaaacagaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgggcccttcatttgaggcaggccgcgag

SEQ ID NO: 1086 - protein, 261 aa, Artificial Sequence
  Variant of Glucose Dehydrogenase from Bacillus subtilis
MYPDLKGKVVAITGAATGLGRAMAIRFGKEQAKVVINYYTNTQDPNAVKEEVIKAGGEAVVVQGDVTKEEDVKNIVQTAIKEFGTLDIMINNAGVENPVPSHELPLKDWDKVIATNLTGAFLGSREAIKYFVENDIKGNVINMSSVREVIPWPLNVHYAASKGGMKLMTKTLALEYARRGIRVNNIGPGAINTTGNAERWADPKQKADVESMIPMGYIGEPEEIAAVAAWLASKEASYVTGITLFADGGMTLGPSFEAGRE

SEQ ID NO: 1087 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgcgcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtaattccttggccgttaaacgtccactatgccgcaagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaaattaaagctgatgtagaaagcatgattccgatgggatatatcggcgaaccggaggagatcgccgcagtagcatcctggcttgcttcgaaggaagccagctacgtcacaggcatcacgttattcgcggacggcggtatgaccctgggcccttcatttgaggcaggccgtgag

SEQ ID NO: 1088 - protein, 261 aa, Artificial Sequence
  Variant of Glucose Dehydrogenase from Bacillus subtilis
MYPDLKGKVVAITGAATGLGRAMAIRFGKEQAKVVINYYSNTQDPNAVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREVIPWPLNVHYAASKGGMKLMTKTLALEYASNGIRVNNIGPGAINTTGNAERWADPKIKADVESMIPMGYIGEPEEIAAVASWLASKEASYVTGITLFADGGMTLGPSFEAGRE

SEQ ID NO: 1089 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgcgcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaggtcatcgcgacgaacttaacgggtgcctttttaggaagccgtgaagcgattaaatatttcgtagaaaacgatatcaagggaaatgtcattaacatgtccagtgtgcgtgaagtgattccttggccgttaaacgtccactatgccgcaagtaaaggcgggatgaagctgatgacaaaaacattagcgttggaatacgcgctgaatggcattcgcgtcaataatattgggccaggtgcgatcaacacgacgggtaatgctgagcgctgggctgaccctaaacagaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgggccctttttttgagccaggccaggag

SEQ ID NO: 1090 - protein, 261 aa, Artificial Sequence
  Variant of Glucose Dehydrogenase from Bacillus subtilis
MYPDLKGKVVAITGAATGLGRAMAIRFGKEQAKVVINYYSNTQDPNAVKEEVIKAGGEAVVVQGDVTKEEDVKNIVQTAIKEFGTLDIMINNAGVENPVPSHELPLKDWDKVIATNLTGAFLGSREAIKYFVENDIKGNVINMSSVREVIPWPLNVHYAASKGGMKLMTKTLALEYALNGIRVNNIGPGAINTTGNAERWADPKQKADVESMIPMGYIGEPEEIAAVAAWLASKEASYVTGITLFADGGMTLGPFFEPGQE

SEQ ID NO: 1091 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtaattccttggccgttaaacgtccactatgccgcaagtaaaggcgggatgaagctgatgacaaaaacattagcgttggaatacgcgcgtcgtggcattcgcgtcaataatattgggccaggtgcgatcaacacgacgggtaatgctgagcgctgggctgaccctaaacagaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgggccctgcgtttgaggcaggccaggag

SEQ ID NO: 1092 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREVIPWPLNVHYAASKGGMKLMTKTLALEYARRGIRVNNIGPGAINTTGNAERWADPKQKADVESMIPMGYIGEPEEIAAVAAWLASKEASYVTGITLFADGGMTLGPAFEAGQE

SEQ ID NO: 1093 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgcgcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtaattccttggccgttaaacgtccactatgccgcaagtaaaggcgggatgaagctgatgacaaaaacattagcgttggaatacgcgtcgaacggcattcgcgtcaataatattgggccaggtgcgatcaacacgacgggtaataaggagcgctgggctgaccctaaacagaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgggcccttcatttgaggcaggccgtgag

SEQ ID NO: 1094 - protein, 261 aa, Artificial Sequence
  Variant of Glucose Dehydrogenase from Bacillus subtilis
MYPDLKGKVVAITGAATGLGRAMAIRFGKEQAKVVINYYSNTQDPNAVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREVIPWPLNVHYAASKGGMKLMTKTLALEYASNGIRVNNIGPGAINTTGNKERWADPKQKADVESMIPMGYIGEPEEIAAVAAWLASKEASYVTGITLFADGGMTLGPSFEAGRE

SEQ ID NO: 1095 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgcgcgatggccattcgcttcggcaaggagcatgcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtaattccttggccgttaaacgtccactatgccgcaagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaacagaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgggcccttcatttgaggcaggccgtgag

SEQ ID NO: 1096 - protein, 261 aa, Artificial Sequence
  Variant of Glucose Dehydrogenase from Bacillus subtilis
MYPDLKGKVVAITGAATGLGRAMAIRFGKEHAKVVINYYSNTQDPNAVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREVIPWPLNVHYAASKGGMKLMTKTLALEYASNGIRVNNIGPGAINTTGNAERWADPKQKADVESMIPMGYIGEPEEIAAVAAWLASKEASYVTGITLFADGGMTLGPSFEAGRE

SEQ ID NO: 1097 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtaattccttggccgttaaacgtccactatgccgcgagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaacagaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgggccctgcgtttgaggcaggccgcgag

SEQ ID NO: 1098 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVQGDVTKEEDVKNIVQTAIKEFGTLDIMINNAGVENPVPSHELPLKDWDKVIATNLTGAFLGSREAIKYFVENDIKGNVINMSSVREVIPWPLNVHYAASKGGMKLMTKTLALEYASNGIRVNNIGPGAINTTGNAERWADPKQKADVESMIPMGYIGEPEEIAAVAAWLASKEASYVTGITLFADGGMTLGPAFEAGRE

SEQ ID NO: 1099 - DNA, 783 bp, Artificial Sequence
  Variant of Glucose Dehydrogenase from Bacillus subtilis
atgtattgtgatttaaaaggaaaagtcgtcgctattacaggagctgctaccgggctcggacgcgcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtaattccttggccgttaaacgtccactatgccgcaagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaacagaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgggcccttcatttgaggcaggccgtgag

SEQ ID NO: 1100 - protein, 261 aa, Artificial Sequence
  Variant of Glucose Dehydrogenase from Bacillus subtilis
MYCDLKGKVVAITGAATGLGRAMAIRFGKEQAKVVINYYSNTQDPNAVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREVIPWPLNVHYAASKGGMKLMTKTLALEYASNGIRVNNIGPGAINTTGNAERWADPKQKADVESMIPMGYIGEPEEIAAVAAWLASKEASYVTGITLFADGGMTLGPSFEAGRE

SEQ ID NO: 1101 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgcgcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtaattccttggccgttaaacgtccactatgccgcaagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaaacgaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgggcccttcatttgaggcaggccgtgag

SEQ ID NO: 1102 - protein, 261 aa, Artificial Sequence
  Variant of Glucose Dehydrogenase from Bacillus subtilis
MYPDLKGKVVAITGAATGLGRAMAIRFGKEQAKVVINYYSNTQDPNAVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREVIPWPLNVHYAASKGGMKLMTKTLALEYASNGIRVNNIGPGAINTTGNAERWADPKTKADVESMIPMGYIGEPEEIAAVAAWLASKEASYVTGITLFADGGMTLGPSFEAGRE

SEQ ID NO: 1103 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgcgcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgttaaacgtccactatgccgcaagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaacagaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgggccctttttttgaggcaggccaggag

SEQ ID NO: 1104 - protein, 261 aa, Artificial Sequence
  Variant of Glucose Dehydrogenase from Bacillus subtilis
MYPDLKGKVVAITGAATGLGRAMAIRFGKEQAKVVINYYSNTQDPNAVKEEVIKAGGEAVVVQGDVTKEEDVKNIVQTAIKEFGTLDIMINNAGVENPVPSHELPLKDWDKVIATNLTGAFLGSREAIKYFVENDIKGNVINMSSVREVIPWPLNVHYAASKGGMKLMTKTLALEYASNGIRVNNIGPGAINTTGNAERWADPKQKADVESMIPMGYIGEPEEIAAVAAWLASKEASYVTGITLFADGGMTLGPFFEAGQE

SEQ ID NO: 1105 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgcgcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggatattgtcatcgcgacgaacttaacgggtgcctttttaggaagccgtgaagcgattaaatatttcgtagaaaacgatatcaagggaaatgtcattaacatgtccagtgtgcgtgaagtgattccttggccgttaaacgtccactatgcctcgagtaaaggcgggatgaagctgatgacaaaaacattagcgttggaatacgcgtcgaatggcattcgcgtcaataatattgggccaggtgcgatcaacacgacgggtaatgctgagcgctgggctgaccctaaacagaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgggccctttttttgaggcaggccaggag

SEQ ID NO: 1106 - protein, 261 aa, Artificial Sequence
  Variant of Glucose Dehydrogenase from Bacillus subtilis
MYPDLKGKVVAITGAATGLGRAMAIRFGKEQAKVVINYYSNTQDPNAVKEEVIKAGGEAVVVQGDVTKEEDVKNIVQTAIKEFGTLDIMINNAGVENPVPSHEMPLKDWDIVIATNLTGAFLGSREAIKYFVENDIKGNVINMSSVREVIPWPLNVHYASSKGGMKLMTKTLALEYASNGIRVNNIGPGAINTTGNAERWADPKQKADVESMIPMGYIGEPEEIAAVAAWLASKEASYVTGITLFADGGMTLGPFFEAGQE

SEQ ID NO: 1107 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgcgcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaggtcatcgcgacgaacttaacgggtgcctttttaggaagccgtgaagcgattaaatatttcgtagaaaacgatatcaagggaaatgtcattaacatgtccagtgtgcgtgaagagattccttggccgttaaacgtccactatgccgcgagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaacagaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgggcccttcgtttgagccaggccgcgag

SEQ ID NO: 1108 - protein, 261 aa, Artificial Sequence
  Variant of Glucose Dehydrogenase from Bacillus subtilis
MYPDLKGKVVAITGAATGLGRAMAIRFGKEQAKVVINYYSNTQDPNAVKEEVIKAGGEAVVVQGDVTKEEDVKNIVQTAIKEFGTLDIMINNAGVENPVPSHELPLKDWDKVIATNLTGAFLGSREAIKYFVENDIKGNVINMSSVREEIPWPLNVHYAASKGGMKLMTKTLALEYASNGIRVNNIGPGAINTTGNAERWADPKQKADVESMIPMGYIGEPEEIAAVAAWLASKEASYVTGITLFADGGMTLGPSFEPGRE

SEQ ID NO: 1109 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgcgcgatggccattcgcttcggcaaggagcaggcaaaagtggttatcaactattatagtaacacgcaagatccgatcgctgtaaaagaagaggtcatcaaggcgggcggtgaagctgttgttgtccagggagatgtcacgaaagaggaagatgtaaaaaatatcgtgcaaacggcaattaagcagttcggcacactcgatattatgattaataatgccggtgtcgaaaatcctgtgccatctcacgaaatgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtaattccttggccgttaaacgtccactatgccgcaagtaaaggcgggatgaagctgatgacaaaaacattagcgttggaatacgcgtcgaacggtattcgcgtcaataatattgggccaggtgcgatcaacacgacgggtaatgctgagcgctgggctgaccctaaacagaaagctgatgtagaaagcatgattccgatgggatatatcggcgaaccggaggaaatcgccgcagttgcagcctggcttgcttcgaaggaagccagctacgtcacaggcatcacgttattcgcggacggcggtatgaccctgggcccttcatttgaggcaaaccgtgag

SEQ ID NO: 1110 - protein, 261 aa, Artificial Sequence
  Variant of Glucose Dehydrogenase from Bacillus subtilis
MYPDLKGKVVAITGAATGLGRAMAIRFGKEQAKVVINYYSNTQDPIAVKEEVIKAGGEAVVVQGDVTKEEDVKNIVQTAIKQFGTLDIMINNAGVENPVPSHEMPLKDWDKVIATNLTGAFLGSREAIKYFVENDIKGNVINMSSVREVIPWPLNVHYAASKGGMKLMTKTLALEYASNGIRVNNIGPGAINTTGNAERWADPKQKADVESMIPMGYIGEPEEIAAVAAWLASKEASYVTGITLFADGGMTLGPSFEANRE

SEQ ID NO: 1111 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgcgcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggatgaggtcatcgcgacgaacttaacgggtgcctttttaggaagccgtgaagcgattaaatatttcgtagaaaacgatatcaagggaaatgtcattaacatgtccagtgtgcgtgaagagattccttggccgttaaacgtccactatgccgcaagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaacagaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgggccctttttttgagccaggccgcgag

SEQ ID NO: 1112 - protein, 261 aa, Artificial Sequence
  Variant of Glucose Dehydrogenase from Bacillus subtilis
MYPDLKGKVVAITGAATGLGRAMAIRFGKEQAKVVINYYSNTQDPNAVKEEVIKAGGEAVVVQGDVTKEEDVKNIVQTAIKEFGTLDIMINNAGVENPVPSHEMPLKDWDEVIATNLTGAFLGSREAIKYFVENDIKGNVINMSSVREEIPWPLNVHYAASKGGMKLMTKTLALEYASNGIRVNNIGPGAINTTGNAERWADPKQKADVESMIPMGYIGEPEEIAAVAAWLASKEASYVTGITLFADGGMTLGPFFEPGRE

SEQ ID NO: 1113 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgcgcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaggtcatcgcgacgaacttaacgggtgcctttttaggaagccgtgaagcgattaaatatttcgtagaaaacgatatcaagggaaatgtcattaacatgtccagtgtgcgtgaagtaattccttggccgttaaacgtccactatgccgcaagtaaaggcgggatgaagctgatgacaaaaacattagcgttggaatacgcggcgcgtggcattcgcgtcaataatattgggccaggtgcgatcaacacgacgggtaatgctgagcgctgggctgaccctaaacagaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgggccctgcgtttgagccaggccgcgag

SEQ ID NO: 1114 - protein, 261 aa, Artificial Sequence
  Variant of Glucose Dehydrogenase from Bacillus subtilis
MYPDLKGKVVAITGAATGLGRAMAIRFGKEQAKVVINYYSNTQDPNAVKEEVIKAGGEAVVVQGDVTKEEDVKNIVQTAIKEFGTLDIMINNAGVENPVPSHELPLKDWDKVIATNLTGAFLGSREAIKYFVENDIKGNVINMSSVREVIPWPLNVHYAASKGGMKLMTKTLALEYAARGIRVNNIGPGAINTTGNAERWADPKQKADVESMIPMGYIGEPEEIAAVAAWLASKEASYVTGITLFADGGMTLGPAFEPGRE

SEQ ID NO: 1115 - DNA, 783 bp, Artificial Sequence
  Variant of Glucose Dehydrogenase from Bacillus subtilis
atgtatactgatttaaaaggaaaagtcgtcgctattacaggagctgctaccgggctcggacgcgcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtaattccttggccgttaaacgtccactatgccgcaagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaacagaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgggcccttcatttgaggcaggccgtgag

SEQ ID NO: 1116 - protein, 261 aa, Artificial Sequence
  Variant of Glucose Dehydrogenase from Bacillus subtilis
MYTDLKGKVVAITGAATGLGRAMAIRFGKEQAKVVINYYSNTQDPNAVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREVIPWPLNVHYAASKGGMKLMTKTLALEYASNGIRVNNIGPGAINTTGNAERWADPKQKADVESMIPMGYIGEPEEIAAVAAWLASKEASYVTGITLFADGGMTLGPSFEAGRE

SEQ ID NO: 1117 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgcgcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtaattccttggccgttaaacgtccactatgcctctagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaacagaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgggcccttcatttgaggcaggccgtgag

SEQ ID NO: 1118 - protein, 261 aa, Artificial Sequence
  Variant of Glucose Dehydrogenase from Bacillus subtilis
MYPDLKGKVVAITGAATGLGRAMAIRFGKEQAKVVINYYSNTQDPNAVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREVIPWPLNVHYASSKGGMKLMTKTLALEYASNGIRVNNIGPGAINTTGNAERWADPKQKADVESMIPMGYIGEPEEIAAVAAWLASKEASYVTGITLFADGGMTLGPSFEAGRE

SEQ ID NO: 1119 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgcgcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtaattccttggccgttaaacgtccactatgccgcaagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaacagaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgtatccttcatttgaggcaggccgtgag

SEQ ID NO: 1120 - protein, 261 aa, Artificial Sequence
  Variant of Glucose Dehydrogenase from Bacillus subtilis
MYPDLKGKVVAITGAATGLGRAMAIRFGKEQAKVVINYYSNTQDPNAVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREVIPWPLNVHYAASKGGMKLMTKTLALEYASNGIRVNNIGPGAINTTGNAERWADPKQKADVESMIPMGYIGEPEEIAAVAAWLASKEASYVTGITLFADGGMTLYPSFEAGRE

SEQ ID NO: 1121 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgcgcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtaattccttggccgttaaacgtccactatgccgcaagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaacagaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgggcccttcatttagggcaggccgtgag

SEQ ID NO: 1122 - protein, 261 aa, Artificial Sequence
  Variant of Glucose Dehydrogenase from Bacillus subtilis
MYPDLKGKVVAITGAATGLGRAMAIRFGKEQAKVVINYYSNTQDPNAVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREVIPWPLNVHYAASKGGMKLMTKTLALEYASNGIRVNNIGPGAINTTGNAERWADPKQKADVESMIPMGYIGEPEEIAAVAAWLASKEASYVTGITLFADGGMTLGPSFRAGRE

SEQ ID NO: 1123 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgcgcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaggtcatcgcgacgaacttaacgggtgcctttttaggaagccgtgaagcgattaaatatttcgtagaaaacgatatcaagggaaatgtcattaacatgtccagtgtgcgtgaagtaattccttggccgttaaacgtccactatgccgcaagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaacagaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgggcccttcgtttgaggcaggccaggag

SEQ ID NO: 1124 - protein, 261 aa, Artificial Sequence
  Variant of Glucose Dehydrogenase from Bacillus subtilis
MYPDLKGKVVAITGAATGLGRAMAIRFGKEQAKVVINYYSNTQDPNAVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREVIPWPLNVHYAASKGGMKLMTKTLALEYASNGIRVNNIGPGAINTTGNAERWADPKQKADVESMIPMGYIGEPEEIAAVAAWLASKEASYVTGITLFADGGMTLGPSFEAGQE

SEQ ID NO: 1125 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgcgcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtaattccttggccgttaaacgtccactatgcctcgagtaaaggcgggatgaagctgatgacaaaaacattagcgttggaatacgcgcgtcgtggcattcgcgtcaataatattgggccaggtgcgatcaacacgacgggtaatgctgagcgctgggctgaccctaaacagaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgggccctgcgtttgaggcaggccgcgag

SEQ ID NO: 1126 - protein, 261 aa, Artificial Sequence
  Variant of Glucose Dehydrogenase from Bacillus subtilis
MYPDLKGKVVAITGAATGLGRAMAIRFGKEQAKVVINYYSNTQDPNAVKEEVIKAGGEAVVVQGDVTKEEDVKNIVQTAIKEFGTLDIMINNAGVENPVPSHELPLKDWDKVIATNLTGAFLGSREAIKYFVENDIKGNVINMSSVREVIPWPLNVHYASSKGGMKLMTKTLALEYARRGIRVNNIGPGAINTTGNAERWADPKQKADVESMIPMGYIGEPEEIAAVAAWLASKEASYVTGITLFADGGMTLGPAFEAGRE

SEQ ID NO: 1127 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtaattccttggccgttaaacgtccactatgccgcaagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaacagaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgggccctgcgtttgaggcaggccaggag

SEQ ID NO: 1128 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREVIPWPLNVHYAASKGGMKLMTKTLALEYASNGIRVNNIGPGAINTTGNAERWADPKQKADVESMIPMGYIGEPEEIAAVAAWLASKEASYVTGITLFADGGMTLGPAFEAGQE

SEQ ID NO: 1129 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtaattccttggccgttaaacgtccactatgccgcaagtaaaggcgggatgaagctgatgacaaaaacattagcgttggaatacgcgcgtcgtggcattcgcgtcaataatattgggccaggtgcgatcaacacgacgggtaatgctgagcgctgggctgaccctaaacagaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgggccctttttttgaggcaggccgcgag

SEQ ID NO: 1130 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVQGDVTKEEDVKNIVQTAIKEFGTLDIMINNAGVENPVPSHELPLKDWDKVIATNLTGAFLGSREAIKYFVENDIKGNVINMSSVREVIPWPLNVHYAASKGGMKLMTKTLALEYARRGIRVNNIGPGAINTTGNAERWADPKQKADVESMIPMGYIGEPEEIAAVAAWLASKEASYVTGITLFADGGMTLGPFFEAGRE

SEQ ID NO: 1131 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgcgcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtaattccttggccgttaaacgtccactatgcctcgagtaaaggcgggatgaagctgatgacaaaaacattagcgttggaatacgcgctgcgtggcattcgcgtcaataatattgggccaggtgcgatcaacacgacgggtaatgctgagcgctgggctgaccctaaacagaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgggcccttcatttgaggcaggccgtgag

SEQ ID NO: 1132 - protein, 261 aa, Artificial Sequence
  Variant of Glucose Dehydrogenase from Bacillus subtilis
MYPDLKGKVVAITGAATGLGRAMAIRFGKEQAKVVINYYSNTQDPNAVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREVIPWPLNVHYASSKGGMKLMTKTLALEYALRGIRVNNIGPGAINTTGNAERWADPKQKADVESMIPMGYIGEPEEIAAVAAWLASKEASYVTGITLFADGGMTLGPSFEAGRE

SEQ ID NO: 1133 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgcgcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtaattccttggccgcataacgtccactatgccgcaagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaacagaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgggcccttcatttgaggcaggccgtgag

SEQ ID NO: 1134 - protein, 261 aa, Artificial Sequence
  Variant of Glucose Dehydrogenase from Bacillus subtilis
MYPDLKGKVVAITGAATGLGRAMAIRFGKEQAKVVINYYSNTQDPNAVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREVIPWPHNVHYAASKGGMKLMTKTLALEYASNGIRVNNIGPGAINTTGNAERWADPKQKADVESMIPMGYIGEPEEIAAVAAWLASKEASYVTGITLFADGGMTLGPSFEAGRE

SEQ ID NO: 1135 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgcgcgatggccattcgcttcggcaaggagcagatgaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtaattccttggccgttaaacgtccactatgccgcaagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaacagaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgggcccttcatttgaggcaggccgtgag

SEQ ID NO: 1136 - protein, 261 aa, Artificial Sequence
  Variant of Glucose Dehydrogenase from Bacillus subtilis
MYPDLKGKVVAITGAATGLGRAMAIRFGKEQMKVVINYYSNTQDPNAVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREVIPWPLNVHYAASKGGMKLMTKTLALEYASNGIRVNNIGPGAINTTGNAERWADPKQKADVESMIPMGYIGEPEEIAAVAAWLASKEASYVTGITLFADGGMTLGPSFEAGRE

SEQ ID NO: 1137 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgcgcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtaattccttggccgttaaacgtccactatgccgcaagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaattgaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgggcccttcatttgaggcaggccgtgag

SEQ ID NO: 1138 - protein, 261 aa, Artificial Sequence
  Variant of Glucose Dehydrogenase from Bacillus subtilis
MYPDLKGKVVAITGAATGLGRAMAIRFGKEQAKVVINYYSNTQDPNAVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREVIPWPLNVHYAASKGGMKLMTKTLALEYASNGIRVNNIGPGAINTTGNAERWADPKLKADVESMIPMGYIGEPEEIAAVAAWLASKEASYVTGITLFADGGMTLGPSFEAGRE

SEQ ID NO: 1139 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtaattccttggccgttaaacgtccactatgccgcaagtaaaggcgggatgaagctgatgacaaaaacattagcgttggaatacgcgtcgaatggcattcgcgtcaataatattgggccaggtgcgatcaacacgacgggtaatgctgagcgctgggctgaccctaaacagaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgggccctttttttgagccaggccgcgag

SEQ ID NO: 1140 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVQGDVTKEEDVKNIVQTAIKEFGTLDIMINNAGVENPVPSHELPLKDWDKVIATNLTGAFLGSREAIKYFVENDIKGNVINMSSVREVIPWPLNVHYAASKGGMKLMTKTLALEYASNGIRVNNIGPGAINTTGNAERWADPKQKADVESMIPMGYIGEPEEIAAVAAWLASKEASYVTGITLFADGGMTLGPFFEPGRE

SEQ ID NO: 1141 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgcgcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtaattccttggccgttaaacgcgcactatgccgcaagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaacagaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgggcccttcatttgaggcaggccgtgag

SEQ ID NO: 1142 - protein, 261 aa, Artificial Sequence
  Variant of Glucose Dehydrogenase from Bacillus subtilis
MYPDLKGKVVAITGAATGLGRAMAIRFGKEQAKVVINYYSNTQDPNAVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREVIPWPLNAHYAASKGGMKLMTKTLALEYASNGIRVNNIGPGAINTTGNAERWADPKQKADVESMIPMGYIGEPEEIAAVAAWLASKEASYVTGITLFADGGMTLGPSFEAGRE

SEQ ID NO: 1143 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaggtcatcgcgacgaacttaacgggtgcctttttaggaagccgtgaagcgattaaatatttcgtagaaaacgatatcaagggaaatgtcattaacatgtccagtgtgcgtgaagtgattccttggccgttaaacgtccactatgcctcgagtaaaggcgggatgaagctgatgacaaaaacattagcgttggaatacgcgctgcgtggcattcgcgtcaataatattgggccaggtgcgatcaacacgacgggtaatgctgagcgctgggctgaccctaaacagaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgggcccttcatttgaggcaggccgtgag

SEQ ID NO: 1144 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVQGDVTKEEDVKNIVQTAIKEFGTLDIMINNAGVENPVPSHELPLKDWDKVIATNLTGAFLGSREAIKYFVENDIKGNVINMSSVREVIPWPLNVHYASSKGGMKLMTKTLALEYALRGIRVNNIGPGAINTTGNAERWADPKQKADVESMIPMGYIGEPEEIAAVAAWLASKEASYVTGITLFADGGMTLGPSFEAGRE

SEQ ID NO: 1145 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaggtcatcgcgacgaacttaacgggtgcctttttaggaagccgtgaagcgattaaatatttcgtagaaaacgatatcaagggaaatgtcattaacatgtccagtgtgcgtgaagtaattccttggccgttaaacgtccactatgccgcgagtaaaggcgggatgaagctgatgacaaaaacattagcgttggaatacgcgcgtaatggcattcgcgtcaataatattgggccaggtgcgatcaacacgacgggtaatgctgagcgctgggctgaccctaaacagaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgggccctttttttgagccaggccgcgag

SEQ ID NO: 1146 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVQGDVTKEEDVKNIVQTAIKEFGTLDIMINNAGVENPVPSHELPLKDWDKVIATNLTGAFLGSREAIKYFVENDIKGNVINMSSVREVIPWPLNVHYAASKGGMKLMTKTLALEYARNGIRVNNIGPGAINTTGNAERWADPKQKADVESMIPMGYIGEPEEIAAVAAWLASKEASYVTGITLFADGGMTLGPFFEPGRE

SEQ ID NO: 1147 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgcgcgatggccattcgcttcggcaaggagcaggcaaaagtggttatcaactattataagaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtaattccttggccgttaaacgtccactatgccgcaagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaacagaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgggcccttcatttgaggcaggccgtgag

SEQ ID NO: 1148 - protein, 261 aa, Artificial Sequence
  Variant of Glucose Dehydrogenase from Bacillus subtilis
MYPDLKGKVVAITGAATGLGRAMAIRFGKEQAKVVINYYKNTQDPNAVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREVIPWPLNVHYAASKGGMKLMTKTLALEYASNGIRVNNIGPGAINTTGNAERWADPKQKADVESMIPMGYIGEPEEIAAVAAWLASKEASYVTGITLFADGGMTLGPSFEAGRE

SEQ ID NO: 1149 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgcgcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtaattccttggccgttaaacgtccactatgccgcaagtaaaggcgggatgaagctgatgacaaaaacattagcgttggaatacgcgtcgaacggcattcgcgtcaataatattgggccaggtgcgatcaacacgctgggtaatgctgagcgctgggctgaccctaaacagaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgggcccttcatttgaggcaggccgtgag

SEQ ID NO: 1150 - protein, 261 aa, Artificial Sequence
  Variant of Glucose Dehydrogenase from Bacillus subtilis
MYPDLKGKVVAITGAATGLGRAMAIRFGKEQAKVVINYYSNTQDPNAVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREVIPWPLNVHYAASKGGMKLMTKTLALEYASNGIRVNNIGPGAINTLGNAERWADPKQKADVESMIPMGYIGEPEEIAAVAAWLASKEASYVTGITLFADGGMTLGPSFEAGRE

SEQ ID NO: 1151 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgcgcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtaattccttggccgttaaacgtccactatgccgcaagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaacagaaagctgatgtagaaagcatgattccgatgggatatatcggcgaaccgtttgagatcgccgcagtagcagcctggcttgcttcgaaggaagccagctacgtcacaggcatcacgttattcgcggacggcggtatgaccctgggcccttcatttgaggcaggccgtgag

SEQ ID NO: 1152 - protein, 261 aa, Artificial Sequence
  Variant of Glucose Dehydrogenase from Bacillus subtilis
MYPDLKGKVVAITGAATGLGRAMAIRFGKEQAKVVINYYSNTQDPNAVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREVIPWPLNVHYAASKGGMKLMTKTLALEYASNGIRVNNIGPGAINTTGNAERWADPKQKADVESMIPMGYIGEPFEIAAVAAWLASKEASYVTGITLFADGGMTLGPSFEAGRE

SEQ ID NO: 1153 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgcgcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtaattccttggccgtggaacgtccactatgccgcaagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaacagaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgggcccttcatttgaggcaggccgtgag

SEQ ID NO: 1154 - protein, 261 aa, Artificial Sequence
  Variant of Glucose Dehydrogenase from Bacillus subtilis
MYPDLKGKVVAITGAATGLGRAMAIRFGKEQAKVVINYYSNTQDPNAVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREVIPWPWNVHYAASKGGMKLMTKTLALEYASNGIRVNNIGPGAINTTGNAERWADPKQKADVESMIPMGYIGEPEEIAAVAAWLASKEASYVTGITLFADGGMTLGPSFEAGRE

SEQ ID NO: 1155 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgcgcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggatctggtcatcgcgacgaacttaacgggtgcctttttaggaagccgtgaagcgattaaatatttcgtagaaaacgatatcaagggaaatgtcattaacatgtccagtgtgcgtgaagtgattccttggccgttaaacgtccactatgcctcgagtaaaggcgggatgaagctgatgacaaaaacattagcgttggaatacgcggcgcgtggcattcgcgtcaataatattgggccaggtgcgatcaacacgacgggtaatgctgagcgctgggctgaccctaaacagaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgggccctgcgtttgagccaggccaggag

SEQ ID NO: 1156 - protein, 261 aa, Artificial Sequence
  Variant of Glucose Dehydrogenase from Bacillus subtilis
MYPDLKGKVVAITGAATGLGRAMAIRFGKEQAKVVINYYSNTQDPNAVKEEVIKAGGEAVVVQGDVTKEEDVKNIVQTAIKEFGTLDIMINNAGVENPVPSHEMPLKDWDLVIATNLTGAFLGSREAIKYFVENDIKGNVINMSSVREVIPWPLNVHYASSKGGMKLMTKTLALEYAARGIRVNNIGPGAINTTGNAERWADPKQKADVESMIPMGYIGEPEEIAAVAAWLASKEASYVTGITLFADGGMTLGPAFEPGQE

SEQ ID NO: 1157 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgcgcgatggccattcgcttcggcaaggagcaggcaaaagtggttatcaactattatactaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaggtcatcgcgacgaacttaacgggtgcctttttaggaagccgtgaagcgattaaatatttcgtagaaaacgatatcaagggaaatgtcattaacatgtccagtgtgcgtgaagtgattccttggccgttaaacgtccactatgcctcgagtaaaggcgggatgaagctgatgacaaaaacattagcgttggaatacgcgctgaatggcattcgcgtcaataatattgggccaggtgcgatcaacacgacgggtaatgctgagcgctgggctgaccctaaacagaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgggcccttcatttgaggcaggccgtgag

SEQ ID NO: 1158 - protein, 261 aa, Artificial Sequence
  Variant of Glucose Dehydrogenase from Bacillus subtilis
MYPDLKGKVVAITGAATGLGRAMAIRFGKEQAKVVINYYTNTQDPNAVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREVIPWPLNVHYASSKGGMKLMTKTLALEYALNGIRVNNIGPGAINTTGNAERWADPKQKADVESMIPMGYIGEPEEIAAVAAWLASKEASYVTGITLFADGGMTLGPSFEAGRE

SEQ ID NO: 1159 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgcgcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtaattccttggccgttaaacactcactatgccgcaagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaacagaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgggcccttcatttgaggcaggccgtgag

SEQ ID NO: 1160 - protein, 261 aa, Artificial Sequence
  Variant of Glucose Dehydrogenase from Bacillus subtilis
MYPDLKGKVVAITGAATGLGRAMAIRFGKEQAKVVINYYSNTQDPNAVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREVIPWPLNTHYAASKGGMKLMTKTLALEYASNGIRVNNIGPGAINTTGNAERWADPKQKADVESMIPMGYIGEPEEIAAVAAWLASKEASYVTGITLFADGGMTLGPSFEAGRE

SEQ ID NO: 1161 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgcgcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacaagatgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtaattccttggccgttaaacgtccactatgccgcaagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaacagaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgggcccttcatttgaggcaggccgtgag

SEQ ID NO: 1162 - protein, 261 aa, Artificial Sequence
  Variant of Glucose Dehydrogenase from Bacillus subtilis
MYPDLKGKVVAITGAATGLGRAMAIRFGKEQAKVVINYYSNTQDPNAVKEEVIKAGGEAVVVQGDVTKEEDVKNIVQTAIKEFGTLDIMINNAGVENPVPSHKMPLKDWDKVIATNLTGAFLGSREAIKYFVENDIKGNVINMSSVREVIPWPLNVHYAASKGGMKLMTKTLALEYASNGIRVNNIGPGAINTTGNAERWADPKQKADVESMIPMGYIGEPEEIAAVAAWLASKEASYVTGITLFADGGMTLGPSFEAGRE

SEQ ID NO: 1163 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgcgcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaggtcatcgcgacgaacttaacgggtgcctttttaggaagccgtgaagcgattaaatatttcgtagaaaacgatatcaagggaaatgtcattaacatgtccagtgtgcgtgaagtaattccttggccgttaaacgtccactatgcctcgagtaaaggcgggatgaagctgatgacaaaaacattagcgttggaatacgcggcgaatggcattcgcgtcaataatattgggccaggtgcgatcaacacgacgggtaatgctgagcgctgggctgaccctaaacagaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgggccctgcgtttgaggcaggccaggag

SEQ ID NO: 1164 - protein, 261 aa, Artificial Sequence
  Variant of Glucose Dehydrogenase from Bacillus subtilis
MYPDLKGKVVAITGAATGLGRAMAIRFGKEQAKVVINYYSNTQDPNAVKEEVIKAGGEAVVVQGDVTKEEDVKNIVQTAIKEFGTLDIMINNAGVENPVPSHELPLKDWDKVIATNLTGAFLGSREAIKYFVENDIKGNVINMSSVREVIPWPLNVHYASSKGGMKLMTKTLALEYAANGIRVNNIGPGAINTTGNAERWADPKQKADVESMIPMGYIGEPEEIAAVAAWLASKEASYVTGITLFADGGMTLGPAFEAGQE

SEQ ID NO: 1165 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgcgcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtaattccttggccgttaaacgtccactatgcctcgagtaaaggcgggatgaagctgatgacaaaaacattagcgttggaatacgcgaagcgtggcattcgcgtcaataatattgggccaggtgcgatcaacacgacgggtaatgctgagcgctgggctgaccctaaacagaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgggcccttcgtttgaggcaggccaggag

SEQ ID NO: 1166 - protein, 261 aa, Artificial Sequence
  Variant of Glucose Dehydrogenase from Bacillus subtilis
MYPDLKGKVVAITGAATGLGRAMAIRFGKEQAKVVINYYSNTQDPNAVKEEVIKAGGEAVVVQGDVTKEEDVKNIVQTAIKEFGTLDIMINNAGVENPVPSHELPLKDWDKVIATNLTGAFLGSREAIKYFVENDIKGNVINMSSVREVIPWPLNVHYASSKGGMKLMTKTLALEYAKRGIRVNNIGPGAINTTGNAERWADPKQKADVESMIPMGYIGEPEEIAAVAAWLASKEASYVTGITLFADGGMTLGPSFEAGQE

SEQ ID NO: 1167 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgcgcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggatgaggtcatcgcgacgaacttaacgggtgcctttttaggaagccgtgaagcgattaaatatttcgtagaaaacgatatcaagggaaatgtcattaacatgtccagtgtgcgtgaagagattccttggccgttaaacgtccactatgccgcgagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaacagaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgggccctttttttgaggcaggccaggag

SEQ ID NO: 1168 - protein, 261 aa, Artificial Sequence
  Variant of Glucose Dehydrogenase from Bacillus subtilis
MYPDLKGKVVAITGAATGLGRAMAIRFGKEQAKVVINYYSNTQDPNAVKEEVIKAGGEAVVVQGDVTKEEDVKNIVQTAIKEFGTLDIMINNAGVENPVPSHEMPLKDWDEVIATNLTGAFLGSREAIKYFVENDIKGNVINMSSVREEIPWPLNVHYAASKGGMKLMTKTLALEYASNGIRVNNIGPGAINTTGNAERWADPKQKADVESMIPMGYIGEPEEIAAVAAWLASKEASYVTGITLFADGGMTLGPFFEAGQE

SEQ ID NO: 1169 - DNA, 783 bp, Artificial Sequence
  Variant of Glucose Dehydrogenase from Bacillus subtilis
atgtatccggatttaaaaggaaaagtcgtcgctattacaggagctgctaccgggctcggacgcgcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaaatgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtaattccttggccgttaaacgtccactatgccgcaagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaaatgaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgggcccttcatttgaggcaggccgtgag

SEQ ID NO: 1170 - protein, 261 aa, Artificial Sequence
  Variant of Glucose Dehydrogenase from Bacillus subtilis
MYPDLKGKVVAITGAATGLGRAMAIRFGKEQAKVVINYYSNTQDPNAVKEEVIKAGGEAVVVQGDVTKEEDVKNIVQTAIKEFGTLDIMINNAGVENPVPSHEMPLKDWDKVIATNLTGAFLGSREAIKYFVENDIKGNVINMSSVREVIPWPLNVHYAASKGGMKLMTKTLALEYASNGIRVNNIGPGAINTTGNAERWADPKMKADVESMIPMGYIGEPEEIAAVAAWLASKEASYVTGITLFADGGMTLGPSFEAGRE

SEQ ID NO: 1171 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtcatgggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgttaaacgctcactatgcctcgagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaaactaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctggggcctgcgtttgagccaggccgcgag

SEQ ID NO: 1172 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVMGDVTKEEDVKNIVQTAIKEFGTLDIMINNAGVENPVPSHELPLKDWDKVIATNLTGAFLGSREAIKYFVENDIKGNVINMSSVREVIPWPLNAHYASSKGGMKLMTKTLALEYASNGIRVNNIGPGAINTTGNAERWADPKTKADVESMIPMGYIGEPEEIAAVAAWLASKEASYVTGITLFADGGMTLGPAFEPGRE

SEQ ID NO: 1173 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgcacaacgtccactatgcctcgagtaaaggcgggatgaagctgatgacaaaaacattagcggcagaatacgcgagcaacggcattcgcgtcaataatattgggccaggtgcgatcaacacgacgggtaatgctgagcgctgggctgaccctaaacagaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctggggcctgcgtttgagccaggccgcgag

SEQ ID NO: 1174 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVQGDVTKEEDVKNIVQTAIKEFGTLDIMINNAGVENPVPSHELPLKDWDKVIATNLTGAFLGSREAIKYFVENDIKGNVINMSSVREVIPWPHNVHYASSKGGMKLMTKTLAAEYASNGIRVNNIGPGAINTTGNAERWADPKQKADVESMIPMGYIGEPEEIAAVAAWLASKEASYVTGITLFADGGMTLGPAFEPGRE

SEQ ID NO: 1175 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgcagaacgtccactatgcctcgagtaaaggcgggatgaagctgatgacaaaaacattagcgctggaatacgcgtcgaacggcattcgcgtcaataatattgggccaggtgcgatcaacacgacgggtaatgctgagcgctgggctgaccctaaaatcaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgtatcctgcgtttgagccaggccgcgag

SEQ ID NO: 1176 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVQGDVTKEEDVKNIVQTAIKEFGTLDIMINNAGVENPVPSHELPLKDWDKVIATNLTGAFLGSREAIKYFVENDIKGNVINMSSVREVIPWPQNVHYASSKGGMKLMTKTLALEYASNGIRVNNIGPGAINTTGNAERWADPKIKADVESMIPMGYIGEPEEIAAVAAWLASKEASYVTGITLFADGGMTLYPAFEPGRE

SEQ ID NO: 1177 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgtggaacgtccactatgcctcgagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaaactaaagctgatgtagaaagcatgattccgatgggatatatcggcgaaccggaggagatcgccgcagtagcagcgtggcttgcttcgaaggaagccagctacgtcacaggcatcacgttattcgcggacggcggtatgaccctggggcctgcgtttgagccaggccgcgag

SEQ ID NO: 1178 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVQGDVTKEEDVKNIVQTAIKEFGTLDIMINNAGVENPVPSHELPLKDWDKVIATNLTGAFLGSREAIKYFVENDIKGNVINMSSVREVIPWPWNVHYASSKGGMKLMTKTLALEYASNGIRVNNIGPGAINTTGNAERWADPKTKADVESMIPMGYIGEPEEIAAVAAWLASKEASYVTGITLFADGGMTLGPAFEPGRE

SEQ ID NO: 1179 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgaagaacgtccactatgcctcgagtaaaggcgggatgaagctgatgacaaaaacattagcggcagaatacgcgagcaacggcattcgcgtcaataatattgggccaggtgcgatcaacacgacgggtaatgctgagcgctgggctgaccctaaactgaaagctgatgtagaaagcatgattccgatgggatatatcggcgaaccggaggagatcgccgcagtagcatcgtggcttgcttcgaaggaagccagctacgtcacaggcatcacgttattcgcggacggcggtatgaccctggggcctgcgtttgagccaggccgcgag

SEQ ID NO: 1180 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVQGDVTKEEDVKNIVQTAIKEFGTLDIMINNAGVENPVPSHELPLKDWDKVIATNLTGAFLGSREAIKYFVENDIKGNVINMSSVREVIPWPKNVHYASSKGGMKLMTKTLAAEYASNGIRVNNIGPGAINTTGNAERWADPKLKADVESMIPMGYIGEPEEIAAVASWLASKEASYVTGITLFADGGMTLGPAFEPGRE

SEQ ID NO: 1181 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagagattccttggccgtcaaacgtccactatgcctcgagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaactgaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgggccctgcgtttgagccaggccgcgag

SEQ ID NO: 1182 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVQGDVTKEEDVKNIVQTAIKEFGTLDIMINNAGVENPVPSHELPLKDWDKVIATNLTGAFLGSREAIKYFVENDIKGNVINMSSVREEIPWPSNVHYASSKGGMKLMTKTLALEYASNGIRVNNIGPGAINTTGNAERWADPKLKADVESMIPMGYIGEPEEIAAVAAWLASKEASYVTGITLFADGGMTLGPAFEPGRE

SEQ ID NO: 1183 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgaagaacgtccactatgcctcgagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaacagaaagctgatgtagaaagcatgattccgatgggatatatcggcgaaccggaggagatcgccgcagtagcagcgtggcttgcttcgaaggaagccagctacgtcacaggcatcacgttattcgcggacggcggtatgaccctgtatcctgcgtttgagccaggccgcgag

SEQ ID NO: 1184 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVQGDVTKEEDVKNIVQTAIKEFGTLDIMINNAGVENPVPSHELPLKDWDKVIATNLTGAFLGSREAIKYFVENDIKGNVINMSSVREVIPWPKNVHYASSKGGMKLMTKTLALEYASNGIRVNNIGPGAINTTGNAERWADPKQKADVESMIPMGYIGEPEEIAAVAAWLASKEASYVTGITLFADGGMTLYPAFEPGRE

SEQ ID NO: 1185 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattattcgaatacgcaagatccgaacgctgtaaaagaagaggtcatcaaggcgggcggtgaagctgttgtcgtcatgggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgcacaacgtccactatgcctcgagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaactgaaagctgatgtagaaagcatgattccgatgggatatatcggcgaaccggaggagatcgccgcagtagcatcgtggcttgcttcgaaggaagccagctacgtcacaggcatcacgttattcgcggacggcggtatgaccctggggcctgcgtttgagccaggccgcgag

SEQ ID NO: 1186 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVMGDVTKEEDVKNIVQTAIKEFGTLDIMINNAGVENPVPSHELPLKDWDKVIATNLTGAFLGSREAIKYFVENDIKGNVINMSSVREVIPWPHNVHYASSKGGMKLMTKTLALEYASNGIRVNNIGPGAINTTGNAERWADPKLKADVESMIPMGYIGEPEEIAAVASWLASKEASYVTGITLFADGGMTLGPAFEPGRE

SEQ ID NO: 1187 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgtggaacgtccactatgcctcgagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaaatcaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgggccctgcgtttgagccaggccgcgag

SEQ ID NO: 1188 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVQGDVTKEEDVKNIVQTAIKEFGTLDIMINNAGVENPVPSHELPLKDWDKVIATNLTGAFLGSREAIKYFVENDIKGNVINMSSVREVIPWPWNVHYASSKGGMKLMTKTLALEYASNGIRVNNIGPGAINTTGNAERWADPKIKADVESMIPMGYIGEPEEIAAVAAWLASKEASYVTGITLFADGGMTLGPAFEPGRE

SEQ ID NO: 1189 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgttaaacgtgcactatgcctcgagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaactgaaagctgatgtagaaagcatgattccgatgggatatatcggcgaaccggaggagatcgccgcagtagcagcgtggcttgcttcgaaggaagccagctacgtcacaggcatcacgttattcgcggacggcggtatgaccctggggcctgcgtttgagccaggccgcgag

SEQ ID NO: 1190 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVQGDVTKEEDVKNIVQTAIKEFGTLDIMINNAGVENPVPSHELPLKDWDKVIATNLTGAFLGSREAIKYFVENDIKGNVINMSSVREVIPWPLNVHYASSKGGMKLMTKTLALEYASNGIRVNNIGPGAINTTGNAERWADPKLKADVESMIPMGYIGEPEEIAAVAAWLASKEASYVTGITLFADGGMTLGPAFEPGRE

SEQ ID NO: 1191 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgtggaacgtccactatgcctcgagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaaactaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgtatcctgcgtttgagccaggccgcgag

SEQ ID NO: 1192 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVQGDVTKEEDVKNIVQTAIKEFGTLDIMINNAGVENPVPSHELPLKDWDKVIATNLTGAFLGSREAIKYFVENDIKGNVINMSSVREVIPWPWNVHYASSKGGMKLMTKTLALEYASNGIRVNNIGPGAINTTGNAERWADPKTKADVESMIPMGYIGEPEEIAAVAAWLASKEASYVTGITLFADGGMTLYPAFEPGRE

SEQ ID NO: 1193 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgcacaacgtccactatgcctcgagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaactgaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgtatcctgcgtttgagccaggccgcgag

SEQ ID NO: 1194 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVQGDVTKEEDVKNIVQTAIKEFGTLDIMINNAGVENPVPSHELPLKDWDKVIATNLTGAFLGSREAIKYFVENDIKGNVINMSSVREVIPWPHNVHYASSKGGMKLMTKTLALEYASNGIRVNNIGPGAINTTGNAERWADPKLKADVESMIPMGYIGEPEEIAAVAAWLASKEASYVTGITLFADGGMTLYPAFEPGRE

SEQ ID NO: 1195 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtcatgggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgttaaacgtccactatgcctcgagtaaaggcgggatgaagctgatgacaaaaacattagcgctggaatacgcgagcaacggcattcgcgtcaataatattgggccaggtgcgatcaacacgacgggtaatgctgagcgctgggctgaccctaaaatgaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgtatcctgcgtttgagccaggccgcgag

SEQ ID NO: 1196 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVMGDVTKEEDVKNIVQTAIKEFGTLDIMINNAGVENPVPSHELPLKDWDKVIATNLTGAFLGSREAIKYFVENDIKGNVINMSSVREVIPWPLNVHYASSKGGMKLMTKTLALEYASNGIRVNNIGPGAINTTGNAERWADPKMKADVESMIPMGYIGEPEEIAAVAAWLASKEASYVTGITLFADGGMTLYPAFEPGRE

SEQ ID NO: 1197 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtcatgggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgttaaacgtgcactatgcctcgagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaaactaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgtatcctgcgtttgagccaggccgcgag

SEQ ID NO: 1198 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVMGDVTKEEDVKNIVQTAIKEFGTLDIMINNAGVENPVPSHELPLKDWDKVIATNLTGAFLGSREAIKYFVENDIKGNVINMSSVREVIPWPLNVHYASSKGGMKLMTKTLALEYASNGIRVNNIGPGAINTTGNAERWADPKTKADVESMIPMGYIGEPEEIAAVAAWLASKEASYVTGITLFADGGMTLYPAFEPGRE

SEQ ID NO: 1199 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgctgaacgtccactatgcctcgagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaacagaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgtatcctgcgtttgagccaggccgcgag

SEQ ID NO: 1200 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVQGDVTKEEDVKNIVQTAIKEFGTLDIMINNAGVENPVPSHELPLKDWDKVIATNLTGAFLGSREAIKYFVENDIKGNVINMSSVREVIPWPLNVHYASSKGGMKLMTKTLALEYASNGIRVNNIGPGAINTTGNAERWADPKQKADVESMIPMGYIGEPEEIAAVAAWLASKEASYVTGITLFADGGMTLYPAFEPGRE

SEQ ID NO: 1201 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtcatgggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgttaaacgtccactatgcctcgagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaactgaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctggggcctgcgtttgagccaggccgcgag

SEQ ID NO: 1202 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVMGDVTKEEDVKNIVQTAIKEFGTLDIMINNAGVENPVPSHELPLKDWDKVIATNLTGAFLGSREAIKYFVENDIKGNVINMSSVREVIPWPLNVHYASSKGGMKLMTKTLALEYASNGIRVNNIGPGAINTTGNAERWADPKLKADVESMIPMGYIGEPEEIAAVAAWLASKEASYVTGITLFADGGMTLGPAFEPGRE

SEQ ID NO: 1203 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtcatgggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgcacaacgtccactatgcctcgagtaaaggcgggatgaagctgatgacaaaaacattagcgctggaatacgcgaagaacggcattcgcgtcaataatattgggccaggtgcgatcaacacgacgggtaatgctgagcgctgggctgaccctaaaatcaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgtatcctgcgtttgagccaggccgcgag

SEQ ID NO: 1204 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVMGDVTKEEDVKNIVQTAIKEFGTLDIMINNAGVENPVPSHELPLKDWDKVIATNLTGAFLGSREAIKYFVENDIKGNVINMSSVREVIPWPHNVHYASSKGGMKLMTKTLALEYAKNGIRVNNIGPGAINTTGNAERWADPKIKADVESMIPMGYIGEPEEIAAVAAWLASKEASYVTGITLFADGGMTLYPAFEPGRE

SEQ ID NO: 1205 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgtggaacgtccactatgcctcgagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaactgaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgggccctgcgtttgagccaggccgcgag

SEQ ID NO: 1206 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVQGDVTKEEDVKNIVQTAIKEFGTLDIMINNAGVENPVPSHELPLKDWDKVIATNLTGAFLGSREAIKYFVENDIKGNVINMSSVREVIPWPWNVHYASSKGGMKLMTKTLALEYASNGIRVNNIGPGAINTTGNAERWADPKLKADVESMIPMGYIGEPEEIAAVAAWLASKEASYVTGITLFADGGMTLGPAFEPGRE

SEQ ID NO: 1207 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtcatgggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgtggaacgtgcactatgcctcgagtaaaggcgggatgaagctgatgacaaaaacattagcgctggaatacgcgaagaacggcattcgcgtcaataatattgggccaggtgcgatcaacacgacgggtaatgctgagcgctgggctgaccctaaactgaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgtatcctgcgtttgagccaggccgcgag

SEQ ID NO: 1208 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVMGDVTKEEDVKNIVQTAIKEFGTLDIMINNAGVENPVPSHELPLKDWDKVIATNLTGAFLGSREAIKYFVENDIKGNVINMSSVREVIPWPWNVHYASSKGGMKLMTKTLALEYAKNGIRVNNIGPGAINTTGNAERWADPKLKADVESMIPMGYIGEPEEIAAVAAWLASKEASYVTGITLFADGGMTLYPAFEPGRE

SEQ ID NO: 1209 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatacgaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgcagaacgtccactatgcctcgagtaaaggcgggatgaagctgatgacaaaaacattagcgctggaatacgcgagcaacggcattcgcgtcaataatattgggccaggtgcgatcaacacgacgggtaatgctgagcgctgggctgaccctaaaactaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctggggcctgcgtttgagccaggccgcgag

SEQ ID NO: 1210 - protein, 261 aa, Artificial Sequence
  Variant of Glucose Dehydrogenase from Bacillus subtilis
MYPDLKGKVVAITGAATGLGKAMAIRFGKEQAKVVINYYTNTQDPNAVKEEVIKAGGEAVVVQGDVTKEEDVKNIVQTAIKEFGTLDIMINNAGVENPVPSHELPLKDWDKVIATNLTGAFLGSREAIKYFVENDIKGNVINMSSVREVIPWPQNVHYASSKGGMKLMTKTLALEYASNGIRVNNIGPGAINTTGNAERWADPKTKADVESMIPMGYIGEPEEIAAVAAWLASKEASYVTGITLFADGGMTLGPAFEPGRE

SEQ ID NO: 1211 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtcatgggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgtggaacgtccactatgcctcgagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaaactaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctggggcctgcgtttgagccaggccgcgag

SEQ ID NO: 1212 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVMGDVTKEEDVKNIVQTAIKEFGTLDIMINNAGVENPVPSHELPLKDWDKVIATNLTGAFLGSREAIKYFVENDIKGNVINMSSVREVIPWPWNVHYASSKGGMKLMTKTLALEYASNGIRVNNIGPGAINTTGNAERWADPKTKADVESMIPMGYIGEPEEIAAVAAWLASKEASYVTGITLFADGGMTLGPAFEPGRE

SEQ ID NO: 1213 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtcatgggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagagattccttggccgttaaacgtccactatgcctcgagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaactgaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctggggcctgcgtttgagccaggccgcgag

SEQ ID NO: 1214 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVMGDVTKEEDVKNIVQTAIKEFGTLDIMINNAGVENPVPSHELPLKDWDKVIATNLTGAFLGSREAIKYFVENDIKGNVINMSSVREEIPWPLNVHYASSKGGMKLMTKTLALEYASNGIRVNNIGPGAINTTGNAERWADPKLKADVESMIPMGYIGEPEEIAAVAAWLASKEASYVTGITLFADGGMTLGPAFEPGRE

SEQ ID NO: 1215 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtcatgggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgaagaacgtccactatgcctcgagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaaactaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgtatcctgcgtttgagccaggccgcgag

SEQ ID NO: 1216 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVMGDVTKEEDVKNIVQTAIKEFGTLDIMINNAGVENPVPSHELPLKDWDKVIATNLTGAFLGSREAIKYFVENDIKGNVINMSSVREVIPWPKNVHYASSKGGMKLMTKTLALEYASNGIRVNNIGPGAINTTGNAERWADPKTKADVESMIPMGYIGEPEEIAAVAAWLASKEASYVTGITLFADGGMTLYPAFEPGRE

SEQ ID NO: 1217 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgaagaacgtccactatgcctcgagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaaatcaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgggccctgcgtttgagccaggccgcgag

SEQ ID NO: 1218 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVQGDVTKEEDVKNIVQTAIKEFGTLDIMINNAGVENPVPSHELPLKDWDKVIATNLTGAFLGSREAIKYFVENDIKGNVINMSSVREVIPWPKNVHYASSKGGMKLMTKTLALEYASNGIRVNNIGPGAINTTGNAERWADPKIKADVESMIPMGYIGEPEEIAAVAAWLASKEASYVTGITLFADGGMTLGPAFEPGRE

SEQ ID NO: 1219 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtcatgggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagagattccttggccgctgaacgtccactatgcctcgagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaactgaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgtatcctgcgtttgagccaggccgcgag

SEQ ID NO: 1220 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVMGDVTKEEDVKNIVQTAIKEFGTLDIMINNAGVENPVPSHELPLKDWDKVIATNLTGAFLGSREAIKYFVENDIKGNVINMSSVREEIPWPLNVHYASSKGGMKLMTKTLALEYASNGIRVNNIGPGAINTTGNAERWADPKLKADVESMIPMGYIGEPEEIAAVAAWLASKEASYVTGITLFADGGMTLYPAFEPGRE

SEQ ID NO: 1221 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgtggaacgtccactatgcctcgagtaaaggcgggatgaagctgatgacaaaaacattagcggcagaatacgcgaagaacggcattcgcgtcaataatattgggccaggtgcgatcaacacgacgggtaatgctgagcgctgggctgaccctaaaactaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctggggcctgcgtttgagccaggccgcgag

SEQ ID NO: 1222 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVQGDVTKEEDVKNIVQTAIKEFGTLDIMINNAGVENPVPSHELPLKDWDKVIATNLTGAFLGSREAIKYFVENDIKGNVINMSSVREVIPWPWNVHYASSKGGMKLMTKTLAAEYAKNGIRVNNIGPGAINTTGNAERWADPKTKADVESMIPMGYIGEPEEIAAVAAWLASKEASYVTGITLFADGGMTLGPAFEPGRE

SEQ ID NO: 1223 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgttaaacgtccactatgcctcgagtaaaggcgggatgaagctgatgacaaaaacattagcgttggaatacgcgtcgaacggcattcgcgtcaataatattgggccaggtgcgatcaacacgcatggtaatgctgagcgctgggctgaccctaaacagaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgggccctgcgtttgagccaggccgcgag

SEQ ID NO: 1224 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVQGDVTKEEDVKNIVQTAIKEFGTLDIMINNAGVENPVPSHELPLKDWDKVIATNLTGAFLGSREAIKYFVENDIKGNVINMSSVREVIPWPLNVHYASSKGGMKLMTKTLALEYASNGIRVNNIGPGAINTHGNAERWADPKQKADVESMIPMGYIGEPEEIAAVAAWLASKEASYVTGITLFADGGMTLGPAFEPGRE

SEQ ID NO: 1225 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgttaaacgtccactatgcctcgagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaacagaaagctcttgtagaaagcatgattccgatgggatatatcggcgaaccggaggagatcgccgcagtagcagcctggcttgcttcgaaggaagccagctacgtcacaggcatcacgttattcgcggacggcggtatgaccctgggccctgcgtttgagccaggccgcgag

SEQ ID NO: 1226 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVQGDVTKEEDVKNIVQTAIKEFGTLDIMINNAGVENPVPSHELPLKDWDKVIATNLTGAFLGSREAIKYFVENDIKGNVINMSSVREVIPWPLNVHYASSKGGMKLMTKTLALEYASNGIRVNNIGPGAINTTGNAERWADPKQKALVESMIPMGYIGEPEEIAAVAAWLASKEASYVTGITLFADGGMTLGPAFEPGRE

SEQ ID NO: 1227 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgttaaacgctcactatgcctcgagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaaatgaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgtatcctgcgtttgagccaggccgcgag

SEQ ID NO: 1228 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVQGDVTKEEDVKNIVQTAIKEFGTLDIMINNAGVENPVPSHELPLKDWDKVIATNLTGAFLGSREAIKYFVENDIKGNVINMSSVREVIPWPLNAHYASSKGGMKLMTKTLALEYASNGIRVNNIGPGAINTTGNAERWADPKMKADVESMIPMGYIGEPEEIAAVAAWLASKEASYVTGITLFADGGMTLYPAFEPGRE

SEQ ID NO: 1229 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgttaaacgtccactatgcctcgagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaaactaaagctgatgtagaaagcatgattccgatgggatatatcggcgaaccggaggagatcgccgcagtagcatcgtggcttgcttcgaaggaagccagctacgtcacaggcatcacgttattcgcggacggcggtatgaccctggggcctgcgtttgagccaggccgcgag

SEQ ID NO: 1230 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVQGDVTKEEDVKNIVQTAIKEFGTLDIMINNAGVENPVPSHELPLKDWDKVIATNLTGAFLGSREAIKYFVENDIKGNVINMSSVREVIPWPLNVHYASSKGGMKLMTKTLALEYASNGIRVNNIGPGAINTTGNAERWADPKTKADVESMIPMGYIGEPEEIAAVASWLASKEASYVTGITLFADGGMTLGPAFEPGRE

SEQ ID NO: 1231 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtcatgggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgttaaacgtgcactatgcctcgagtaaaggcgggatgaagctgatgacaaaaacattagcgctggaatacgcgagcaacggcattcgcgtcaataatattgggccaggtgcgatcaacacgacgggtaatgctgagcgctgggctgaccctaaacagaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgggccctgcgtttgagccaggccgcgag

SEQ ID NO: 1232 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVMGDVTKEEDVKNIVQTAIKEFGTLDIMINNAGVENPVPSHELPLKDWDKVIATNLTGAFLGSREAIKYFVENDIKGNVINMSSVREVIPWPLNVHYASSKGGMKLMTKTLALEYASNGIRVNNIGPGAINTTGNAERWADPKQKADVESMIPMGYIGEPEEIAAVAAWLASKEASYVTGITLFADGGMTLGPAFEPGRE

SEQ ID NO: 1233 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgttaaacgtccactatgcctcgagtaaaggcgggatgaagctgatgacaaaaacattagcgctggaatacgcgtcgaacggcattcgcgtcaataatattgggccaggtgcgatcaacacgacgggtaatgctgagcgctgggctgaccctaaaatgaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgggccctgcgtttgagccaggccgcgag

SEQ ID NO: 1234 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVQGDVTKEEDVKNIVQTAIKEFGTLDIMINNAGVENPVPSHELPLKDWDKVIATNLTGAFLGSREAIKYFVENDIKGNVINMSSVREVIPWPLNVHYASSKGGMKLMTKTLALEYASNGIRVNNIGPGAINTTGNAERWADPKMKADVESMIPMGYIGEPEEIAAVAAWLASKEASYVTGITLFADGGMTLGPAFEPGRE

SEQ ID NO: 1235 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagagattccttggccgctgaacgtccactatgcctcgagtaaaggcgggatgaagctgatgacaaaaacattagcgctggaatacgcgagcaacggcattcgcgtcaataatattgggccaggtgcgatcaacacgacgggtaatgctgagcgctgggctgaccctaaaactaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgggccctgcgtttgagccaggccgcgag

SEQ ID NO: 1236 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVQGDVTKEEDVKNIVQTAIKEFGTLDIMINNAGVENPVPSHELPLKDWDKVIATNLTGAFLGSREAIKYFVENDIKGNVINMSSVREEIPWPLNVHYASSKGGMKLMTKTLALEYASNGIRVNNIGPGAINTTGNAERWADPKTKADVESMIPMGYIGEPEEIAAVAAWLASKEASYVTGITLFADGGMTLGPAFEPGRE

SEQ ID NO: 1237 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtcatgggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgttaaacgctcactatgcctcgagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaacagaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgggccctgcgtttgagccaggccgcgag

SEQ ID NO: 1238 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVMGDVTKEEDVKNIVQTAIKEFGTLDIMINNAGVENPVPSHELPLKDWDKVIATNLTGAFLGSREAIKYFVENDIKGNVINMSSVREVIPWPLNAHYASSKGGMKLMTKTLALEYASNGIRVNNIGPGAINTTGNAERWADPKQKADVESMIPMGYIGEPEEIAAVAAWLASKEASYVTGITLFADGGMTLGPAFEPGRE

SEQ ID NO: 1239 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgttaaacgtccactatgcctcgagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaaactaaagctgatgtagaaagcatgattccgatgggatatatcggcgaaccggaggagatcgccgcagtagcatcgtggcttgcttcgaaggaagccagctacgtcacaggcatcacgttattcgcggacggcggtatgaccctgtatcctgcgtttgagccaggccgcgag

SEQ ID NO: 1240 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVQGDVTKEEDVKNIVQTAIKEFGTLDIMINNAGVENPVPSHELPLKDWDKVIATNLTGAFLGSREAIKYFVENDIKGNVINMSSVREVIPWPLNVHYASSKGGMKLMTKTLALEYASNGIRVNNIGPGAINTTGNAERWADPKTKADVESMIPMGYIGEPEEIAAVASWLASKEASYVTGITLFADGGMTLYPAFEPGRE

SEQ ID NO: 1241 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcgaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgttaaacgtgcactatgcctcgagtaaaggcgggatgaagctgatgacaaaaacattagcgctggaatacgcgagcaacggcattcgcgtcaataatattgggccaggtgcgatcaacacgacgggtaatgctgagcgctgggctgaccctaaaatgaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgtatcctgcgtttgagccaggccgcgag

SEQ ID NO: 1242 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIEAGGEAVVVQGDVTKEEDVKNIVQTAIKEFGTLDIMINNAGVENPVPSHELPLKDWDKVIATNLTGAFLGSREAIKYFVENDIKGNVINMSSVREVIPWPLNVHYASSKGGMKLMTKTLALEYASNGIRVNNIGPGAINTTGNAERWADPKMKADVESMIPMGYIGEPEEIAAVAAWLASKEASYVTGITLFADGGMTLYPAFEPGRE

SEQ ID NO: 1243 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtcatgggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagagattccttggccgttaaacactcactatgcctcgagtaaaggcgggatgaagctgatgacaaaaacattagcgttggaatacgcgaagaacggcattcgcgtcaataatattgggccaggtgcgatcaacacgacgggtaatgctgagcgctgggctgaccctaaactgaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgtatcctgcgtttgagccaggccgcgag

SEQ ID NO: 1244 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVMGDVTKEEDVKNIVQTAIKEFGTLDIMINNAGVENPVPSHELPLKDWDKVIATNLTGAFLGSREAIKYFVENDIKGNVINMSSVREEIPWPLNTHYASSKGGMKLMTKTLALEYAKNGIRVNNIGPGAINTTGNAERWADPKLKADVESMIPMGYIGEPEEIAAVAAWLASKEASYVTGITLFADGGMTLYPAFEPGRE

SEQ ID NO: 1245 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgtggaacgtccactatgcctcgagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaacagaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctggggcctgcgtttgagccaggccgcgag

SEQ ID NO: 1246 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVQGDVTKEEDVKNIVQTAIKEFGTLDIMINNAGVENPVPSHELPLKDWDKVIATNLTGAFLGSREAIKYFVENDIKGNVINMSSVREVIPWPWNVHYASSKGGMKLMTKTLALEYASNGIRVNNIGPGAINTTGNAERWADPKQKADVESMIPMGYIGEPEEIAAVAAWLASKEASYVTGITLFADGGMTLGPAFEPGRE

SEQ ID NO: 1247 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgaagaacgtccactatgcctcgagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaacagaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctggggcctgcgtttgagccaggccgcgag

SEQ ID NO: 1248 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVQGDVTKEEDVKNIVQTAIKEFGTLDIMINNAGVENPVPSHELPLKDWDKVIATNLTGAFLGSREAIKYFVENDIKGNVINMSSVREVIPWPKNVHYASSKGGMKLMTKTLALEYASNGIRVNNIGPGAINTTGNAERWADPKQKADVESMIPMGYIGEPEEIAAVAAWLASKEASYVTGITLFADGGMTLGPAFEPGRE

SEQ ID NO: 1249 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgcacaacgtccactatgcctcgagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaacagaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgggccctgcgtttgagccaggccgcgag

SEQ ID NO: 1250 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVQGDVTKEEDVKNIVQTAIKEFGTLDIMINNAGVENPVPSHELPLKDWDKVIATNLTGAFLGSREAIKYFVENDIKGNVINMSSVREVIPWPHNVHYASSKGGMKLMTKTLALEYASNGIRVNNIGPGAINTTGNAERWADPKQKADVESMIPMGYIGEPEEIAAVAAWLASKEASYVTGITLFADGGMTLGPAFEPGRE

SEQ ID NO: 1251 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgcacaacgtccactatgcctcgagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaaactaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgggccctgcgtttgagccaggccgcgag

SEQ ID NO: 1252 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVQGDVTKEEDVKNIVQTAIKEFGTLDIMINNAGVENPVPSHELPLKDWDKVIATNLTGAFLGSREAIKYFVENDIKGNVINMSSVREVIPWPHNVHYASSKGGMKLMTKTLALEYASNGIRVNNIGPGAINTTGNAERWADPKTKADVESMIPMGYIGEPEEIAAVAAWLASKEASYVTGITLFADGGMTLGPAFEPGRE

SEQ ID NO: 1253 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgtggaacgtccactatgcctcgagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaaatgaaagctgatgtagaaagcatgattccgatgggatatatcggcgaaccggaggagatcgccgcagtagcagcgtggcttgcttcgaaggaagccagctacgtcacaggcatcacgttattcgcggacggcggtatgaccctgggccctgcgtttgagccaggccgcgag

SEQ ID NO: 1254 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVQGDVTKEEDVKNIVQTAIKEFGTLDIMINNAGVENPVPSHELPLKDWDKVIATNLTGAFLGSREAIKYFVENDIKGNVINMSSVREVIPWPWNVHYASSKGGMKLMTKTLALEYASNGIRVNNIGPGAINTTGNAERWADPKMKADVESMIPMGYIGEPEEIAAVAAWLASKEASYVTGITLFADGGMTLGPAFEPGRE

SEQ ID NO: 1255 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtcatgggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgaagaacgtccactatgcctcgagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaactgaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgggccctgcgtttgagccaggccgcgag

SEQ ID NO: 1256 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVMGDVTKEEDVKNIVQTAIKEFGTLDIMINNAGVENPVPSHELPLKDWDKVIATNLTGAFLGSREAIKYFVENDIKGNVINMSSVREVIPWPKNVHYASSKGGMKLMTKTLALEYASNGIRVNNIGPGAINTTGNAERWADPKLKADVESMIPMGYIGEPEEIAAVAAWLASKEASYVTGITLFADGGMTLGPAFEPGRE

SEQ ID NO: 1257 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgtggaacgtccactatgcctcgagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaacagaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgtatcctgcgtttgagccaggccgcgag

SEQ ID NO: 1258 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVQGDVTKEEDVKNIVQTAIKEFGTLDIMINNAGVENPVPSHELPLKDWDKVIATNLTGAFLGSREAIKYFVENDIKGNVINMSSVREVIPWPWNVHYASSKGGMKLMTKTLALEYASNGIRVNNIGPGAINTTGNAERWADPKQKADVESMIPMGYIGEPEEIAAVAAWLASKEASYVTGITLFADGGMTLYPAFEPGRE

SEQ ID NO: 1259 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtcatgggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagagattccttggccgaagaacgtccactatgcctcgagtaaaggcgggatgaagctgatgacaaaaacattagcggcagaatacgcgaagaacggcattcgcgtcaataatattgggccaggtgcgatcaacacgacgggtaatgctgagcgctgggctgaccctaaacagaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgtatcctgcgtttgagccaggccgcgag

SEQ ID NO: 1260 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVMGDVTKEEDVKNIVQTAIKEFGTLDIMINNAGVENPVPSHELPLKDWDKVIATNLTGAFLGSREAIKYFVENDIKGNVINMSSVREEIPWPKNVHYASSKGGMKLMTKTLAAEYAKNGIRVNNIGPGAINTTGNAERWADPKQKADVESMIPMGYIGEPEEIAAVAAWLASKEASYVTGITLFADGGMTLYPAFEPGRE

SEQ ID NO: 1261 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtcatgggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgcagaacgtgcactatgcctcgagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaaatcaaagctgatgtagaaagcatgattccgatgggatatatcggcgaaccggaggagatcgccgcagtagcatcgtggcttgcttcgaaggaagccagctacgtcacaggcatcacgttattcgcggacggcggtatgaccctgtatcctgcgtttgagccaggccgcgag

SEQ ID NO: 1262 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVMGDVTKEEDVKNIVQTAIKEFGTLDIMINNAGVENPVPSHELPLKDWDKVIATNLTGAFLGSREAIKYFVENDIKGNVINMSSVREVIPWPQNVHYASSKGGMKLMTKTLALEYASNGIRVNNIGPGAINTTGNAERWADPKIKADVESMIPMGYIGEPEEIAAVASWLASKEASYVTGITLFADGGMTLYPAFEPGRE

SEQ ID NO: 1263 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgtggaacgtccactatgcctcgagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaacagaaagctgatgtagaaagcatgattccgatgggatatatcggcgaaccggaggagatcgccgcagtagcatcgtggcttgcttcgaaggaagccagctacgtcacaggcatcacgttattcgcggacggcggtatgaccctggggcctgcgtttgagccaggccgcgag

SEQ ID NO: 1264 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVQGDVTKEEDVKNIVQTAIKEFGTLDIMINNAGVENPVPSHELPLKDWDKVIATNLTGAFLGSREAIKYFVENDIKGNVINMSSVREVIPWPWNVHYASSKGGMKLMTKTLALEYASNGIRVNNIGPGAINTTGNAERWADPKQKADVESMIPMGYIGEPEEIAAVASWLASKEASYVTGITLFADGGMTLGPAFEPGRE

SEQ ID NO: 1265 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatacgaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgttaaacgtgcactatgcctcgagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaaactaaagctgatgtagaaagcatgattccgatgggatatatcggcgaaccggaggagatcgccgcagtagcatcgtggcttgcttcgaaggaagccagctacgtcacaggcatcacgttattcgcggacggcggtatgaccctgggccctgcgtttgagccaggccgcgag

SEQ ID NO: 1266 - protein, 261 aa, Artificial Sequence
  Variant of Glucose Dehydrogenase from Bacillus subtilis
MYPDLKGKVVAITGAATGLGKAMAIRFGKEQAKVVINYYTNTQDPNAVKEEVIKAGGEAVVVQGDVTKEEDVKNIVQTAIKEFGTLDIMINNAGVENPVPSHELPLKDWDKVIATNLTGAFLGSREAIKYFVENDIKGNVINMSSVREVIPWPLNVHYASSKGGMKLMTKTLALEYASNGIRVNNIGPGAINTTGNAERWADPKTKADVESMIPMGYIGEPEEIAAVASWLASKEASYVTGITLFADGGMTLGPAFEPGRE

SEQ ID NO: 1267 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgttaaacgtccactatgccgcgagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaactgaaagctgatgtagaaagcatgattccgatgggatatatcggcgaaccggaggagatcgccgcagtagcatcgtggcttgcttcgaaggaagccagctacgtcacaggcatcacgttattcgcggacggcggtatgaccctgggccctgcgtttgagccaggccgcgag

SEQ ID NO: 1268 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVQGDVTKEEDVKNIVQTAIKEFGTLDIMINNAGVENPVPSHELPLKDWDKVIATNLTGAFLGSREAIKYFVENDIKGNVINMSSVREVIPWPLNVHYAASKGGMKLMTKTLALEYASNGIRVNNIGPGAINTTGNAERWADPKLKADVESMIPMGYIGEPEEIAAVASWLASKEASYVTGITLFADGGMTLGPAFEPGRE

SEQ ID NO: 1269 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagagattccttggccgctgaacgtccactatgcctcgagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaaatgaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgggccctgcgtttgagccaggccgcgag

SEQ ID NO: 1270 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVQGDVTKEEDVKNIVQTAIKEFGTLDIMINNAGVENPVPSHELPLKDWDKVIATNLTGAFLGSREAIKYFVENDIKGNVINMSSVREEIPWPLNVHYASSKGGMKLMTKTLALEYASNGIRVNNIGPGAINTTGNAERWADPKMKADVESMIPMGYIGEPEEIAAVAAWLASKEASYVTGITLFADGGMTLGPAFEPGRE

SEQ ID NO: 1271 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcacgcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgtggaacgtccactatgcctcgagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaactgaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgggccctgcgtttgagccaggccgcgag

SEQ ID NO: 1272 - protein, 261 aa, Artificial Sequence
  Variant of Glucose Dehydrogenase from Bacillus subtilis
MYPDLKGKVVAITGAATGLGKAMAIRFGKEHAKVVINYYSNTQDPNAVKEEVIKAGGEAVVVQGDVTKEEDVKNIVQTAIKEFGTLDIMINNAGVENPVPSHELPLKDWDKVIATNLTGAFLGSREAIKYFVENDIKGNVINMSSVREVIPWPWNVHYASSKGGMKLMTKTLALEYASNGIRVNNIGPGAINTTGNAERWADPKLKADVESMIPMGYIGEPEEIAAVAAWLASKEASYVTGITLFADGGMTLGPAFEPGRE

SEQ ID NO: 1273 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagagattccttggccgttaaacgctcactatgcctcgagtaaaggcgggatgaagctgatgacaaaaacattagcgttggaatacgcgagcaacggcattcgcgtcaataatattgggccaggtgcgatcaacacgacgggtaatgctgagcgctgggctgaccctaaacagaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgtatcctgcgtttgagccaggccgcgag

SEQ ID NO: 1274 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVQGDVTKEEDVKNIVQTAIKEFGTLDIMINNAGVENPVPSHELPLKDWDKVIATNLTGAFLGSREAIKYFVENDIKGNVINMSSVREEIPWPLNAHYASSKGGMKLMTKTLALEYASNGIRVNNIGPGAINTTGNAERWADPKQKADVESMIPMGYIGEPEEIAAVAAWLASKEASYVTGITLFADGGMTLYPAFEPGRE

SEQ ID NO: 1275 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgaagaacgtccactatgccgcgagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaacagaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgtatcctgcgtttgagccaggccgcgag

SEQ ID NO: 1276 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVQGDVTKEEDVKNIVQTAIKEFGTLDIMINNAGVENPVPSHELPLKDWDKVIATNLTGAFLGSREAIKYFVENDIKGNVINMSSVREVIPWPKNVHYAASKGGMKLMTKTLALEYASNGIRVNNIGPGAINTTGNAERWADPKQKADVESMIPMGYIGEPEEIAAVAAWLASKEASYVTGITLFADGGMTLYPAFEPGRE

SEQ ID NO: 1277 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagagattccttggccgtggaacgtccactatgcctcgagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaacagaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgggccctgcgtttgagccaggccgcgag

SEQ ID NO: 1278 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVQGDVTKEEDVKNIVQTAIKEFGTLDIMINNAGVENPVPSHELPLKDWDKVIATNLTGAFLGSREAIKYFVENDIKGNVINMSSVREEIPWPWNVHYASSKGGMKLMTKTLALEYASNGIRVNNIGPGAINTTGNAERWADPKQKADVESMIPMGYIGEPEEIAAVAAWLASKEASYVTGITLFADGGMTLGPAFEPGRE

SEQ ID NO: 1279 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatacgaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgttaaacgtgcactatgcctcgagtaaaggcgggatgaagctgatgacaaaaacattagcggcagaatacgcgtcgaacggcattcgcgtcaataatattgggccaggtgcgatcaacacgacgggtaatgctgagcgctgggctgaccctaaaatcaaagctgatgtagaaagcatgattccgatgggatatatcggcgaaccggaggagatcgccgcagtagcatcgtggcttgcttcgaaggaagccagctacgtcacaggcatcacgttattcgcggacggcggtatgaccctggggcctgcgtttgagccaggccgcgag

SEQ ID NO: 1280 - protein, 261 aa, Artificial Sequence
  Variant of Glucose Dehydrogenase from Bacillus subtilis
MYPDLKGKVVAITGAATGLGKAMAIRFGKEQAKVVINYYTNTQDPNAVKEEVIKAGGEAVVVQGDVTKEEDVKNIVQTAIKEFGTLDIMINNAGVENPVPSHELPLKDWDKVIATNLTGAFLGSREAIKYFVENDIKGNVINMSSVREVIPWPLNVHYASSKGGMKLMTKTLAAEYASNGIRVNNIGPGAINTTGNAERWADPKIKADVESMIPMGYIGEPEEIAAVASWLASKEASYVTGITLFADGGMTLGPAFEPGRE

SEQ ID NO: 1281 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcacgcaaaagtggttatcaactattatagtaatacgcaagatccgaacgctgtaaaagaagaggtcatcaagtggggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgctgaacgtccactatgcctcgagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaaatcaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgggccctgcgtttgaaccaggccgcgag

SEQ ID NO: 1282 - protein, 261 aa, Artificial Sequence
  Variant of Glucose Dehydrogenase from Bacillus subtilis
MYPDLKGKVVAITGAATGLGKAMAIRFGKEHAKVVINYYSNTQDPNAVKEEVIKWGGEAVVVQGDVTKEEDVKNIVQTAIKEFGTLDIMINNAGVENPVPSHELPLKDWDKVIATNLTGAFLGSREAIKYFVENDIKGNVINMSSVREVIPWPLNVHYASSKGGMKLMTKTLALEYASNGIRVNNIGPGAINTTGNAERWADPKIKADVESMIPMGYIGEPEEIAAVAAWLASKEASYVTGITLFADGGMTLGPAFEPGRE

SEQ ID NO: 1283 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcacgcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgcagaacgtccactatgcctcgagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaactgaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgggccctgcgtttgaaccaggccgcgag

SEQ ID NO: 1284 - protein, 261 aa, Artificial Sequence
  Variant of Glucose Dehydrogenase from Bacillus subtilis
MYPDLKGKVVAITGAATGLGKAMAIRFGKEHAKVVINYYSNTQDPNAVKEEVIKAGGEAVVVQGDVTKEEDVKNIVQTAIKEFGTLDIMINNAGVENPVPSHELPLKDWDKVIATNLTGAFLGSREAIKYFVENDIKGNVINMSSVREVIPWPQNVHYASSKGGMKLMTKTLALEYASNGIRVNNIGPGAINTTGNAERWADPKLKADVESMIPMGYIGEPEEIAAVAAWLASKEASYVTGITLFADGGMTLGPAFEPGRE

SEQ ID NO: 1285 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagagattccttggccgttaaacgtccactatgcctcgagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaaatgaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgtatcctgcgtttgagccaggccgcgag

SEQ ID NO: 1286 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVQGDVTKEEDVKNIVQTAIKEFGTLDIMINNAGVENPVPSHELPLKDWDKVIATNLTGAFLGSREAIKYFVENDIKGNVINMSSVREEIPWPLNVHYASSKGGMKLMTKTLALEYASNGIRVNNIGPGAINTTGNAERWADPKMKADVESMIPMGYIGEPEEIAAVAAWLASKEASYVTGITLFADGGMTLYPAFEPGRE

SEQ ID NO: 1287 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgttaaacgtccactatgccgcgagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaactgaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctggggcctgcgtttgagccaggccgcgag

SEQ ID NO: 1288 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVQGDVTKEEDVKNIVQTAIKEFGTLDIMINNAGVENPVPSHELPLKDWDKVIATNLTGAFLGSREAIKYFVENDIKGNVINMSSVREVIPWPLNVHYAASKGGMKLMTKTLALEYASNGIRVNNIGPGAINTTGNAERWADPKLKADVESMIPMGYIGEPEEIAAVAAWLASKEASYVTGITLFADGGMTLGPAFEPGRE

SEQ ID NO: 1289 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtcatgggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgctgaacgtccactatgcctcgagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaaatgaaagctgatgtagaaagcatgattccgatgggatatatcggcgaaccggaggagatcgccgcagtagcagcgtggcttgcttcgaaggaagccagctacgtcacaggcatcacgttattcgcggacggcggtatgaccctgggccctgcgtttgagccaggccgcgag

SEQ ID NO: 1290 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVMGDVTKEEDVKNIVQTAIKEFGTLDIMINNAGVENPVPSHELPLKDWDKVIATNLTGAFLGSREAIKYFVENDIKGNVINMSSVREVIPWPLNVHYASSKGGMKLMTKTLALEYASNGIRVNNIGPGAINTTGNAERWADPKMKADVESMIPMGYIGEPEEIAAVAAWLASKEASYVTGITLFADGGMTLGPAFEPGRE

SEQ ID NO: 1291 - DNA, 783 bp, Artificial Sequence
  Variant of Glucose Dehydrogenase from Bacillus subtilis
atgtatctggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgtggaacgtccactatgcctcgagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaactgaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgggccctgcgtttgagccaggccgcgag

SEQ ID NO: 1292 - protein, 261 aa, Artificial Sequence
  Variant of Glucose Dehydrogenase from Bacillus subtilis
MYLDLKGKVVAITGAATGLGKAMAIRFGKEQAKVVINYYSNTQDPNAVKEEVIKAGGEAVVVQGDVTKEEDVKNIVQTAIKEFGTLDIMINNAGVENPVPSHELPLKDWDKVIATNLTGAFLGSREAIKYFVENDIKGNVINMSSVREVIPWPWNVHYASSKGGMKLMTKTLALEYASNGIRVNNIGPGAINTTGNAERWADPKLKADVESMIPMGYIGEPEEIAAVAAWLASKEASYVTGITLFADGGMTLGPAFEPGRE

SEQ ID NO: 1293 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgttaaacactcactatgcctcgagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaaactaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgggccctgcgtttgagccaggccgcgag

SEQ ID NO: 1294 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVQGDVTKEEDVKNIVQTAIKEFGTLDIMINNAGVENPVPSHELPLKDWDKVIATNLTGAFLGSREAIKYFVENDIKGNVINMSSVREVIPWPLNTHYASSKGGMKLMTKTLALEYASNGIRVNNIGPGAINTTGNAERWADPKTKADVESMIPMGYIGEPEEIAAVAAWLASKEASYVTGITLFADGGMTLGPAFEPGRE

SEQ ID NO: 1295 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcacgcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgtggaacgtccactatgcctcgagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaaatcaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgggccctgcgtttcgtccaggccgcgag

SEQ ID NO: 1296 - protein, 261 aa, Artificial Sequence
  Variant of Glucose Dehydrogenase from Bacillus subtilis
MYPDLKGKVVAITGAATGLGKAMAIRFGKEHAKVVINYYSNTQDPNAVKEEVIKAGGEAVVVQGDVTKEEDVKNIVQTAIKEFGTLDIMINNAGVENPVPSHELPLKDWDKVIATNLTGAFLGSREAIKYFVENDIKGNVINMSSVREVIPWPWNVHYASSKGGMKLMTKTLALEYASNGIRVNNIGPGAINTTGNAERWADPKIKADVESMIPMGYIGEPEEIAAVAAWLASKEASYVTGITLFADGGMTLGPAFRPGRE

SEQ ID NO: 1297 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgaagaacgtccactatgccgcgagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaacagaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctggggcctgcgtttgagccaggccgcgag

SEQ ID NO: 1298 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVQGDVTKEEDVKNIVQTAIKEFGTLDIMINNAGVENPVPSHELPLKDWDKVIATNLTGAFLGSREAIKYFVENDIKGNVINMSSVREVIPWPKNVHYAASKGGMKLMTKTLALEYASNGIRVNNIGPGAINTTGNAERWADPKQKADVESMIPMGYIGEPEEIAAVAAWLASKEASYVTGITLFADGGMTLGPAFEPGRE

SEQ ID NO: 1299 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgttaaacgtccactatgcctcgagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaactgaaagctgatgtagaaagcatgattccgatgggatatatcggcgaaccgggggagatcgccgcagtagcagcctggcttgcttcgaaggaagccagctacgtcacaggcatcacgttattcgcggacggcggtatgaccctgggccctgcgtttgaaccaggccgcgag

SEQ ID NO: 1300 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVQGDVTKEEDVKNIVQTAIKEFGTLDIMINNAGVENPVPSHELPLKDWDKVIATNLTGAFLGSREAIKYFVENDIKGNVINMSSVREVIPWPLNVHYASSKGGMKLMTKTLALEYASNGIRVNNIGPGAINTTGNAERWADPKLKADVESMIPMGYIGEPGEIAAVAAWLASKEASYVTGITLFADGGMTLGPAFEPGRE

SEQ ID NO: 1301 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagagattccttggccgttaaacgtccactatgcctcgagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaaactaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctggatcctgcgtttgagccaggccgcgag

SEQ ID NO: 1302 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVQGDVTKEEDVKNIVQTAIKEFGTLDIMINNAGVENPVPSHELPLKDWDKVIATNLTGAFLGSREAIKYFVENDIKGNVINMSSVREEIPWPLNVHYASSKGGMKLMTKTLALEYASNGIRVNNIGPGAINTTGNAERWADPKTKADVESMIPMGYIGEPEEIAAVAAWLASKEASYVTGITLFADGGMTLDPAFEPGRE

SEQ ID NO: 1303 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgtggaacgtccactatgcctcgagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaaactaaagctgatgtagaaagcatgattccgatgggatatatcggcgaaccgtatgagatcgccgcagtagcagcctggcttgcttcgaaggaagccagctacgtcacaggcatcacgttattcgcggacggcggtatgaccctgggccctgcgtttgaaccaggccgcgag

SEQ ID NO: 1304 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVQGDVTKEEDVKNIVQTAIKEFGTLDIMINNAGVENPVPSHELPLKDWDKVIATNLTGAFLGSREAIKYFVENDIKGNVINMSSVREVIPWPWNVHYASSKGGMKLMTKTLALEYASNGIRVNNIGPGAINTTGNAERWADPKTKADVESMIPMGYIGEPYEIAAVAAWLASKEASYVTGITLFADGGMTLGPAFEPGRE

SEQ ID NO: 1305 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcaggtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgttaaacgtccactatgcctcgagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaacagaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgggccctgcgtttgagccaggccgcgag

SEQ ID NO: 1306 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVQGDVTKEEDVKNIVQTAIKEFGTLDIMINNAGVENQVPSHELPLKDWDKVIATNLTGAFLGSREAIKYFVENDIKGNVINMSSVREVIPWPLNVHYASSKGGMKLMTKTLALEYASNGIRVNNIGPGAINTTGNAERWADPKQKADVESMIPMGYIGEPEEIAAVAAWLASKEASYVTGITLFADGGMTLGPAFEPGRE

SEQ ID NO: 1307 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtcatgggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgtggaacgtccactatgcctcgagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaaatgaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgggccctgcgtttgagccaggccgcgag

SEQ ID NO: 1308 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVMGDVTKEEDVKNIVQTAIKEFGTLDIMINNAGVENPVPSHELPLKDWDKVIATNLTGAFLGSREAIKYFVENDIKGNVINMSSVREVIPWPWNVHYASSKGGMKLMTKTLALEYASNGIRVNNIGPGAINTTGNAERWADPKMKADVESMIPMGYIGEPEEIAAVAAWLASKEASYVTGITLFADGGMTLGPAFEPGRE

SEQ ID NO: 1309 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcagtaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgttaaacgtccactatgcctcgagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaacagaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgggccctgcgtttgagccaggccgcgag

SEQ ID NO: 1310 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVQGDVSKEEDVKNIVQTAIKEFGTLDIMINNAGVENPVPSHELPLKDWDKVIATNLTGAFLGSREAIKYFVENDIKGNVINMSSVREVIPWPLNVHYASSKGGMKLMTKTLALEYASNGIRVNNIGPGAINTTGNAERWADPKQKADVESMIPMGYIGEPEEIAAVAAWLASKEASYVTGITLFADGGMTLGPAFEPGRE

SEQ ID NO: 1311 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgaagaacgtccactatgccgcgagtaaaggcgggatgaagctgatgacaaaaacattagcgttggaatacgcgagcaacggcattcgcgtcaataatattgggccaggtgcgatcaacacgacgggtaatgctgagcgctgggctgaccctaaaatgaaagctgatgtagaaagcatgattccgatgggatatatcggcgaaccggaggagatcgccgcagtagcagcgtggcttgcttcgaaggaagccagctacgtcacaggcatcacgttattcgcggacggcggtatgaccctggggcctgcgtttgagccaggccgcgag

SEQ ID NO: 1312 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVQGDVTKEEDVKNIVQTAIKEFGTLDIMINNAGVENPVPSHELPLKDWDKVIATNLTGAFLGSREAIKYFVENDIKGNVINMSSVREVIPWPKNVHYAASKGGMKLMTKTLALEYASNGIRVNNIGPGAINTTGNAERWADPKMKADVESMIPMGYIGEPEEIAAVAAWLASKEASYVTGITLFADGGMTLGPAFEPGRE

SEQ ID NO: 1313 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcacgcaaaagtggttatcaactattatagtaatacgcaagatccgaacgctgtaaaagaagaggtcatcaagtggggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgtggaacgtccactatgcctcgagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaaactaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgggccctgcgtttgagccaggccgcgag

SEQ ID NO: 1314 - protein, 261 aa, Artificial Sequence
  Variant of Glucose Dehydrogenase from Bacillus subtilis
MYPDLKGKVVAITGAATGLGKAMAIRFGKEHAKVVINYYSNTQDPNAVKEEVIKWGGEAVVVQGDVTKEEDVKNIVQTAIKEFGTLDIMINNAGVENPVPSHELPLKDWDKVIATNLTGAFLGSREAIKYFVENDIKGNVINMSSVREVIPWPWNVHYASSKGGMKLMTKTLALEYASNGIRVNNIGPGAINTTGNAERWADPKTKADVESMIPMGYIGEPEEIAAVAAWLASKEASYVTGITLFADGGMTLGPAFEPGRE

SEQ ID NO: 1315 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtcatgggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgctgaacgtccactatgcctcgagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaaactaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctggggcctgcgtttgagccaggccgcgag

SEQ ID NO: 1316 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVMGDVTKEEDVKNIVQTAIKEFGTLDIMINNAGVENPVPSHELPLKDWDKVIATNLTGAFLGSREAIKYFVENDIKGNVINMSSVREVIPWPLNVHYASSKGGMKLMTKTLALEYASNGIRVNNIGPGAINTTGNAERWADPKTKADVESMIPMGYIGEPEEIAAVAAWLASKEASYVTGITLFADGGMTLGPAFEPGRE

SEQ ID NO: 1317 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattattcgaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgttaaacgctcactatgcctcgagtaaaggcgggatgaagctgatgacaaaaacattagcgctggaatacgcgtcgaacggcattcgcgtcaataatattgggccaggtgcgatcaacacgacgggtaatgctgagcgctgggctgaccctaaacagaaagctgatgtagaaagcatgattccgatgggatatatcggcgaaccggaggagatcgccgcagtagcatcgtggcttgcttcgaaggaagccagctacgtcacaggcatcacgttattcgcggacggcggtatgaccctgtatcctgcgtttgagccaggccgcgag

SEQ ID NO: 1318 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVQGDVTKEEDVKNIVQTAIKEFGTLDIMINNAGVENPVPSHELPLKDWDKVIATNLTGAFLGSREAIKYFVENDIKGNVINMSSVREVIPWPLNAHYASSKGGMKLMTKTLALEYASNGIRVNNIGPGAINTTGNAERWADPKQKADVESMIPMGYIGEPEEIAAVASWLASKEASYVTGITLFADGGMTLYPAFEPGRE

SEQ ID NO: 1319 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtcatgggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagagattccttggccgttaaacgtgcactatgcctcgagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaaactaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgtatcctgcgtttgagccaggccgcgag

SEQ ID NO: 1320 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVMGDVTKEEDVKNIVQTAIKEFGTLDIMINNAGVENPVPSHELPLKDWDKVIATNLTGAFLGSREAIKYFVENDIKGNVINMSSVREEIPWPLNVHYASSKGGMKLMTKTLALEYASNGIRVNNIGPGAINTTGNAERWADPKTKADVESMIPMGYIGEPEEIAAVAAWLASKEASYVTGITLFADGGMTLYPAFEPGRE

SEQ ID NO: 1321 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcacgcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgtggaacgtccactatgcctcgagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaaatcaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgggccctgcgtttgagccaggccgcgag

SEQ ID NO: 1322 - protein, 261 aa, Artificial Sequence
  Variant of Glucose Dehydrogenase from Bacillus subtilis
MYPDLKGKVVAITGAATGLGKAMAIRFGKEHAKVVINYYSNTQDPNAVKEEVIKAGGEAVVVQGDVTKEEDVKNIVQTAIKEFGTLDIMINNAGVENPVPSHELPLKDWDKVIATNLTGAFLGSREAIKYFVENDIKGNVINMSSVREVIPWPWNVHYASSKGGMKLMTKTLALEYASNGIRVNNIGPGAINTTGNAERWADPKIKADVESMIPMGYIGEPEEIAAVAAWLASKEASYVTGITLFADGGMTLGPAFEPGRE

SEQ ID NO: 1323 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgaagaacgtccactatgccgcgagtaaaggcgggatgaagctgatgacaaaaacattagcgctggaatacgcgtcgaacggcattcgcgtcaataatattgggccaggtgcgatcaacacgacgggtaatgctgagcgctgggctgaccctaaactgaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctggggcctgcgtttgagccaggccgcgag

SEQ ID NO: 1324 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVQGDVTKEEDVKNIVQTAIKEFGTLDIMINNAGVENPVPSHELPLKDWDKVIATNLTGAFLGSREAIKYFVENDIKGNVINMSSVREVIPWPKNVHYAASKGGMKLMTKTLALEYASNGIRVNNIGPGAINTTGNAERWADPKLKADVESMIPMGYIGEPEEIAAVAAWLASKEASYVTGITLFADGGMTLGPAFEPGRE

SEQ ID NO: 1325 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattataagaatacgcaagatccgaacgctgtaaaagaagaggtcatcaagtggggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgctgaacgtccactatgcctcgagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaactgaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgggccctgcgtttgaaccaggccgcgag

SEQ ID NO: 1326 - protein, 261 aa, Artificial Sequence
  Variant of Glucose Dehydrogenase from Bacillus subtilis
MYPDLKGKVVAITGAATGLGKAMAIRFGKEQAKVVINYYKNTQDPNAVKEEVIKWGGEAVVVQGDVTKEEDVKNIVQTAIKEFGTLDIMINNAGVENPVPSHELPLKDWDKVIATNLTGAFLGSREAIKYFVENDIKGNVINMSSVREVIPWPLNVHYASSKGGMKLMTKTLALEYASNGIRVNNIGPGAINTTGNAERWADPKLKADVESMIPMGYIGEPEEIAAVAAWLASKEASYVTGITLFADGGMTLGPAFEPGRE

SEQ ID NO: 1327 - DNA, 783 bp, Artificial Sequence
  Variant of Glucose Dehydrogenase from Bacillus subtilis
atgtatacggatttaaaaggaaaagtcgtcgctattacaggagctgctaccgggctcggaaaagcgatggccattcgcttcggcaaggagcacgcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgttaaacgtccactatgcctcgagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaactgaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgggccctgcgtttgaaccaggccgcgag

SEQ ID NO: 1328 - protein, 261 aa, Artificial Sequence
  Variant of Glucose Dehydrogenase from Bacillus subtilis
MYTDLKGKVVAITGAATGLGKAMAIRFGKEHAKVVINYYSNTQDPNAVKEEVIKAGGEAVVVQGDVTKEEDVKNIVQTAIKEFGTLDIMINNAGVENPVPSHELPLKDWDKVIATNLTGAFLGSREAIKYFVENDIKGNVINMSSVREVIPWPLNVHYASSKGGMKLMTKTLALEYASNGIRVNNIGPGAINTTGNAERWADPKLKADVESMIPMGYIGEPEEIAAVAAWLASKEASYVTGITLFADGGMTLGPAFEPGRE

SEQ ID NO: 1329 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtcatgggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagagattccttggccgtggaacgtccactatgcctcgagtaaaggcgggatgaagctgatgacaaaaacattagcggcagaatacgcgagcaacggcattcgcgtcaataatattgggccaggtgcgatcaacacgacgggtaatgctgagcgctgggctgaccctaaaactaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgtatcctgcgtttgagccaggccgcgag

SEQ ID NO: 1330 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVMGDVTKEEDVKNIVQTAIKEFGTLDIMINNAGVENPVPSHELPLKDWDKVIATNLTGAFLGSREAIKYFVENDIKGNVINMSSVREEIPWPWNVHYASSKGGMKLMTKTLAAEYASNGIRVNNIGPGAINTTGNAERWADPKTKADVESMIPMGYIGEPEEIAAVAAWLASKEASYVTGITLFADGGMTLYPAFEPGRE

SEQ ID NO: 1331 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgaagaacgtccactatgcctcgagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaaatgaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgggccctgcgtttgagccaggccgcgag

SEQ ID NO: 1332 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVQGDVTKEEDVKNIVQTAIKEFGTLDIMINNAGVENPVPSHELPLKDWDKVIATNLTGAFLGSREAIKYFVENDIKGNVINMSSVREVIPWPKNVHYASSKGGMKLMTKTLALEYASNGIRVNNIGPGAINTTGNAERWADPKMKADVESMIPMGYIGEPEEIAAVAAWLASKEASYVTGITLFADGGMTLGPAFEPGRE

SEQ ID NO: 1333 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcacgcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgctgaacgtccactatgcctcgagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaaatcaaagctgatgtagaaagcatgattccgatgggatatatcggcgaaccgcaagagatcgccgcagtagcagcctggcttgcttcgaaggaagccagctacgtcacaggcatcacgttattcgcggacggcggtatgaccctgggccctgcgtttgagccaggccgcgag

SEQ ID NO: 1334 - protein, 261 aa, Artificial Sequence
  Variant of Glucose Dehydrogenase from Bacillus subtilis
MYPDLKGKVVAITGAATGLGKAMAIRFGKEHAKVVINYYSNTQDPNAVKEEVIKAGGEAVVVQGDVTKEEDVKNIVQTAIKEFGTLDIMINNAGVENPVPSHELPLKDWDKVIATNLTGAFLGSREAIKYFVENDIKGNVINMSSVREVIPWPLNVHYASSKGGMKLMTKTLALEYASNGIRVNNIGPGAINTTGNAERWADPKIKADVESMIPMGYIGEPQEIAAVAAWLASKEASYVTGITLFADGGMTLGPAFEPGRE

SEQ ID NO: 1335 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtcatgggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgtggaacgtccactatgcctcgagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaacagaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctggggcctgcgtttgagccaggccgcgag

SEQ ID NO: 1336 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVMGDVTKEEDVKNIVQTAIKEFGTLDIMINNAGVENPVPSHELPLKDWDKVIATNLTGAFLGSREAIKYFVENDIKGNVINMSSVREVIPWPWNVHYASSKGGMKLMTKTLALEYASNGIRVNNIGPGAINTTGNAERWADPKQKADVESMIPMGYIGEPEEIAAVAAWLASKEASYVTGITLFADGGMTLGPAFEPGRE

SEQ ID NO: 1337 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgtggaacgtccactatgcctcgagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaactgaaagctgatgtagaaagcatgattccgatgggatatatcggcgaaccgcgcgagatcgccgcagtagcagcctggcttgcttcgaaggaagccagctacgtcacaggcatcacgttattcgcggacggcggtatgaccctgggccctgcgtttgaaccaggccgcgag

SEQ ID NO: 1338 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVQGDVTKEEDVKNIVQTAIKEFGTLDIMINNAGVENPVPSHELPLKDWDKVIATNLTGAFLGSREAIKYFVENDIKGNVINMSSVREVIPWPWNVHYASSKGGMKLMTKTLALEYASNGIRVNNIGPGAINTTGNAERWADPKLKADVESMIPMGYIGEPREIAAVAAWLASKEASYVTGITLFADGGMTLGPAFEPGRE

SEQ ID NO: 1339 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcacgcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgctgaacgtccactatgcctcgagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaactgaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgggccctgcgtttgagccaggccgcgag

SEQ ID NO: 1340 - protein, 261 aa, Artificial Sequence
  Variant of Glucose Dehydrogenase from Bacillus subtilis
MYPDLKGKVVAITGAATGLGKAMAIRFGKEHAKVVINYYSNTQDPNAVKEEVIKAGGEAVVVQGDVTKEEDVKNIVQTAIKEFGTLDIMINNAGVENPVPSHELPLKDWDKVIATNLTGAFLGSREAIKYFVENDIKGNVINMSSVREVIPWPLNVHYASSKGGMKLMTKTLALEYASNGIRVNNIGPGAINTTGNAERWADPKLKADVESMIPMGYIGEPEEIAAVAAWLASKEASYVTGITLFADGGMTLGPAFEPGRE

SEQ ID NO: 1341 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgttaaacgtccactatgcctcgagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaaactaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgggccctgcgtttgagccaggccgcgag

SEQ ID NO: 1342 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVQGDVTKEEDVKNIVQTAIKEFGTLDIMINNAGVENPVPSHELPLKDWDKVIATNLTGAFLGSREAIKYFVENDIKGNVINMSSVREVIPWPLNVHYASSKGGMKLMTKTLALEYASNGIRVNNIGPGAINTTGNAERWADPKTKADVESMIPMGYIGEPEEIAAVAAWLASKEASYVTGITLFADGGMTLGPAFEPGRE

SEQ ID NO: 1343 - DNA, 783 bp, Artificial Sequence
  Variant of Glucose Dehydrogenase from Bacillus subtilis
atgtattgcgatttaaaaggaaaagtcgtcgctattacaggagctgctaccgggctcggaaaagcgatggccattcgcttcggcaaggagcacgcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgaagaacgtccactatgcctcgagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaaatgaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgggccctgcgtttcgtccaggccgcgag

SEQ ID NO: 1344 - protein, 261 aa, Artificial Sequence
  Variant of Glucose Dehydrogenase from Bacillus subtilis
MYCDLKGKVVAITGAATGLGKAMAIRFGKEHAKVVINYYSNTQDPNAVKEEVIKAGGEAVVVQGDVTKEEDVKNIVQTAIKEFGTLDIMINNAGVENPVPSHELPLKDWDKVIATNLTGAFLGSREAIKYFVENDIKGNVINMSSVREVIPWPKNVHYASSKGGMKLMTKTLALEYASNGIRVNNIGPGAINTTGNAERWADPKMKADVESMIPMGYIGEPEEIAAVAAWLASKEASYVTGITLFADGGMTLGPAFRPGRE

SEQ ID NO: 1345 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgcagaacgtccactatgcctcgagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaactgaaagctgatgtagaaagcatgattccgatgggatatatcggcgaaccgcgcgagatcgccgcagtagcagcctggcttgcttcgaaggaagccagctacgtcacaggcatcacgttattcgcggacggcggtatgaccctgggccctgcgtttcgtccaggccgcgag

SEQ ID NO: 1346 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVQGDVTKEEDVKNIVQTAIKEFGTLDIMINNAGVENPVPSHELPLKDWDKVIATNLTGAFLGSREAIKYFVENDIKGNVINMSSVREVIPWPQNVHYASSKGGMKLMTKTLALEYASNGIRVNNIGPGAINTTGNAERWADPKLKADVESMIPMGYIGEPREIAAVAAWLASKEASYVTGITLFADGGMTLGPAFRPGRE

SEQ ID NO: 1347 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgttaaacgtccactatgcctcgagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaaactaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgtatcctgcgtttgagccaggccgcgag

SEQ ID NO: 1348 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVQGDVTKEEDVKNIVQTAIKEFGTLDIMINNAGVENPVPSHELPLKDWDKVIATNLTGAFLGSREAIKYFVENDIKGNVINMSSVREVIPWPLNVHYASSKGGMKLMTKTLALEYASNGIRVNNIGPGAINTTGNAERWADPKTKADVESMIPMGYIGEPEEIAAVAAWLASKEASYVTGITLFADGGMTLYPAFEPGRE

SEQ ID NO: 1349 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgctgaacgtccactatgcctcgagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaaactaaagctgatgtagaaagcatgattccgatgggatatatcggcgaaccgtatgagatcgccgcagtagcagcctggcttgcttcgaaggaagccagctacgtcacaggcatcacgttattcgcggacggcggtatgaccctgggccctgcgtttgaaccaggccgcgag

SEQ ID NO: 1350 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVQGDVTKEEDVKNIVQTAIKEFGTLDIMINNAGVENPVPSHELPLKDWDKVIATNLTGAFLGSREAIKYFVENDIKGNVINMSSVREVIPWPLNVHYASSKGGMKLMTKTLALEYASNGIRVNNIGPGAINTTGNAERWADPKTKADVESMIPMGYIGEPYEIAAVAAWLASKEASYVTGITLFADGGMTLGPAFEPGRE

SEQ ID NO: 1351 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgttaaacgtccactatgcctcgagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaacagaaagctacggtagaaagcatgattccgatgggatatatcggcgaaccggaggagatcgccgcagtagcagcctggcttgcttcgaaggaagccagctacgtcacaggcatcacgttattcgcggacggcggtatgaccctgggccctgcgtttgagccaggccgcgag

SEQ ID NO: 1352 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVQGDVTKEEDVKNIVQTAIKEFGTLDIMINNAGVENPVPSHELPLKDWDKVIATNLTGAFLGSREAIKYFVENDIKGNVINMSSVREVIPWPLNVHYASSKGGMKLMTKTLALEYASNGIRVNNIGPGAINTTGNAERWADPKQKATVESMIPMGYIGEPEEIAAVAAWLASKEASYVTGITLFADGGMTLGPAFEPGRE

SEQ ID NO: 1353 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgttaaacgtccactatgccgcgagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaaatgaaagctgatgtagaaagcatgattccgatgggatatatcggcgaaccggaggagatcgccgcagtagcatcgtggcttgcttcgaaggaagccagctacgtcacaggcatcacgttattcgcggacggcggtatgaccctgggccctgcgtttgagccaggccgcgag

SEQ ID NO: 1354 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVQGDVTKEEDVKNIVQTAIKEFGTLDIMINNAGVENPVPSHELPLKDWDKVIATNLTGAFLGSREAIKYFVENDIKGNVINMSSVREVIPWPLNVHYAASKGGMKLMTKTLALEYASNGIRVNNIGPGAINTTGNAERWADPKMKADVESMIPMGYIGEPEEIAAVASWLASKEASYVTGITLFADGGMTLGPAFEPGRE

SEQ ID NO: 1355 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgtggaacgtccactatgcctcgagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaaatcaaagctgatgtagaaagcatgattccgatgggatatatcggcgaaccgggggagatcgccgcagtagcagcctggcttgcttcgaaggaagccagctacgtcacaggcatcacgttattcgcggacggcggtatgaccctgggccctgcgtttgagccaggccgcgag

SEQ ID NO: 1356 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVQGDVTKEEDVKNIVQTAIKEFGTLDIMINNAGVENPVPSHELPLKDWDKVIATNLTGAFLGSREAIKYFVENDIKGNVINMSSVREVIPWPWNVHYASSKGGMKLMTKTLALEYASNGIRVNNIGPGAINTTGNAERWADPKIKADVESMIPMGYIGEPGEIAAVAAWLASKEASYVTGITLFADGGMTLGPAFEPGRE

SEQ ID NO: 1357 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtcatgggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagagattccttggccgctgaacgtccactatgcctcgagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaactgaaagctgatgtagaaagcatgattccgatgggatatatcggcgaaccggaggagatcgccgcagtagcatcgtggcttgcttcgaaggaagccagctacgtcacaggcatcacgttattcgcggacggcggtatgaccctgtatcctgcgtttgagccaggccgcgag

SEQ ID NO: 1358 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVMGDVTKEEDVKNIVQTAIKEFGTLDIMINNAGVENPVPSHELPLKDWDKVIATNLTGAFLGSREAIKYFVENDIKGNVINMSSVREEIPWPLNVHYASSKGGMKLMTKTLALEYASNGIRVNNIGPGAINTTGNAERWADPKLKADVESMIPMGYIGEPEEIAAVASWLASKEASYVTGITLFADGGMTLYPAFEPGRE

SEQ ID NO: 1359 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgtggaacgtccactatgcctcgagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaaatcaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgggccctgcgtttcgtccaggccgcgag

SEQ ID NO: 1360 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVQGDVTKEEDVKNIVQTAIKEFGTLDIMINNAGVENPVPSHELPLKDWDKVIATNLTGAFLGSREAIKYFVENDIKGNVINMSSVREVIPWPWNVHYASSKGGMKLMTKTLALEYASNGIRVNNIGPGAINTTGNAERWADPKIKADVESMIPMGYIGEPEEIAAVAAWLASKEASYVTGITLFADGGMTLGPAFRPGRE

SEQ ID NO: 1361 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcacgcaaaagtggttatcaactattatagtaatacgcaagatccgaacgctgtaaaagaagaggtcatcaagtggggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgcagaacgtccactatgcctcgagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaaactaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgggccctgcgtttgaaccaggccgcgag

SEQ ID NO: 1362 - protein, 261 aa, Artificial Sequence
  Variant of Glucose Dehydrogenase from Bacillus subtilis
MYPDLKGKVVAITGAATGLGKAMAIRFGKEHAKVVINYYSNTQDPNAVKEEVIKWGGEAVVVQGDVTKEEDVKNIVQTAIKEFGTLDIMINNAGVENPVPSHELPLKDWDKVIATNLTGAFLGSREAIKYFVENDIKGNVINMSSVREVIPWPQNVHYASSKGGMKLMTKTLALEYASNGIRVNNIGPGAINTTGNAERWADPKTKADVESMIPMGYIGEPEEIAAVAAWLASKEASYVTGITLFADGGMTLGPAFEPGRE

SEQ ID NO: 1363 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgttaaacgtccactatgcctcgagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaacagaaagctcgtgtagaaagcatgattccgatgggatatatcggcgaaccggaggagatcgccgcagtagcagcctggcttgcttcgaaggaagccagctacgtcacaggcatcacgttattcgcggacggcggtatgaccctgggccctgcgtttgagccaggccgcgag

SEQ ID NO: 1364 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVQGDVTKEEDVKNIVQTAIKEFGTLDIMINNAGVENPVPSHELPLKDWDKVIATNLTGAFLGSREAIKYFVENDIKGNVINMSSVREVIPWPLNVHYASSKGGMKLMTKTLALEYASNGIRVNNIGPGAINTTGNAERWADPKQKARVESMIPMGYIGEPEEIAAVAAWLASKEASYVTGITLFADGGMTLGPAFEPGRE

SEQ ID NO: 1365 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatacgaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgcagaacgtccactatgcctcgagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaaactaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgggccctgcgtttcgtccaggccgcgag

SEQ ID NO: 1366 - protein, 261 aa, Artificial Sequence
  Variant of Glucose Dehydrogenase from Bacillus subtilis
MYPDLKGKVVAITGAATGLGKAMAIRFGKEQAKVVINYYTNTQDPNAVKEEVIKAGGEAVVVQGDVTKEEDVKNIVQTAIKEFGTLDIMINNAGVENPVPSHELPLKDWDKVIATNLTGAFLGSREAIKYFVENDIKGNVINMSSVREVIPWPQNVHYASSKGGMKLMTKTLALEYASNGIRVNNIGPGAINTTGNAERWADPKTKADVESMIPMGYIGEPEEIAAVAAWLASKEASYVTGITLFADGGMTLGPAFRPGRE

SEQ ID NO: 1367 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtcatgggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgttaaacgtgcactatgcctcgagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaacagaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgtatcctgcgtttgagccaggccgcgag

SEQ ID NO: 1368 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVMGDVTKEEDVKNIVQTAIKEFGTLDIMINNAGVENPVPSHELPLKDWDKVIATNLTGAFLGSREAIKYFVENDIKGNVINMSSVREVIPWPLNVHYASSKGGMKLMTKTLALEYASNGIRVNNIGPGAINTTGNAERWADPKQKADVESMIPMGYIGEPEEIAAVAAWLASKEASYVTGITLFADGGMTLYPAFEPGRE

SEQ ID NO: 1369 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgtggaacgtccactatgcctcgagtaaaggcgggatgaagctgatgacaaaaacattagcgctggaatacgcgagcaacggcattcgcgtcaataatattgggccaggtgcgatcaacacgacgggtaatgctgagcgctgggctgaccctaaaactaaagctgatgtagaaagcatgattccgatgggatatatcggcgaaccggaggagatcgccgcagtagcatcgtggcttgcttcgaaggaagccagctacgtcacaggcatcacgttattcgcggacggcggtatgaccctggggcctgcgtttgagccaggccgcgag

SEQ ID NO: 1370 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVQGDVTKEEDVKNIVQTAIKEFGTLDIMINNAGVENPVPSHELPLKDWDKVIATNLTGAFLGSREAIKYFVENDIKGNVINMSSVREVIPWPWNVHYASSKGGMKLMTKTLALEYASNGIRVNNIGPGAINTTGNAERWADPKTKADVESMIPMGYIGEPEEIAAVASWLASKEASYVTGITLFADGGMTLGPAFEPGRE

SEQ ID NO: 1371 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgcagaacgtccactatgccgcgagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaactgaaagctgatgtagaaagcatgattccgatgggatatatcggcgaaccgtttgagatcgccgcagtagcagcctggcttgcttcgaaggaagccagctacgtcacaggcatcacgttattcgcggacggcggtatgaccctgggccctgcgtttcgtccaggccgcgag

SEQ ID NO: 1372 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVQGDVTKEEDVKNIVQTAIKEFGTLDIMINNAGVENPVPSHELPLKDWDKVIATNLTGAFLGSREAIKYFVENDIKGNVINMSSVREVIPWPQNVHYAASKGGMKLMTKTLALEYASNGIRVNNIGPGAINTTGNAERWADPKLKADVESMIPMGYIGEPFEIAAVAAWLASKEASYVTGITLFADGGMTLGPAFRPGRE

SEQ ID NO: 1373 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgttaaacgtccactatgcctcgagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaacagaaagctgatgtagaaagcatgattccgatgggatatatcggcgaaccggaggagatcgcctgtgtagcagcctggcttgcttcgaaggaagccagctacgtcacaggcatcacgttattcgcggacggcggtatgaccctgggccctgcgtttgagccaggccgcgag

SEQ ID NO: 1374 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVQGDVTKEEDVKNIVQTAIKEFGTLDIMINNAGVENPVPSHELPLKDWDKVIATNLTGAFLGSREAIKYFVENDIKGNVINMSSVREVIPWPLNVHYASSKGGMKLMTKTLALEYASNGIRVNNIGPGAINTTGNAERWADPKQKADVESMIPMGYIGEPEEIACVAAWLASKEASYVTGITLFADGGMTLGPAFEPGRE

SEQ ID NO: 1375 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgtggaacgtccactatgcctcgagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaaactaaagctgatgtagaaagcatgattccgatgggatatatcggcgaaccgtttgagatcgccgcagtagcagcctggcttgcttcgaaggaagccagctacgtcacaggcatcacgttattcgcggacggcggtatgaccctgggccctgcgtttcgtccaggccgcgag

SEQ ID NO: 1376 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVQGDVTKEEDVKNIVQTAIKEFGTLDIMINNAGVENPVPSHELPLKDWDKVIATNLTGAFLGSREAIKYFVENDIKGNVINMSSVREVIPWPWNVHYASSKGGMKLMTKTLALEYASNGIRVNNIGPGAINTTGNAERWADPKTKADVESMIPMGYIGEPFEIAAVAAWLASKEASYVTGITLFADGGMTLGPAFRPGRE

SEQ ID NO: 1377 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgcagaacgtccactatgcctcgagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaaatgaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgggccctgcgtttcgtccaggccgcgag

SEQ ID NO: 1378 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVQGDVTKEEDVKNIVQTAIKEFGTLDIMINNAGVENPVPSHELPLKDWDKVIATNLTGAFLGSREAIKYFVENDIKGNVINMSSVREVIPWPQNVHYASSKGGMKLMTKTLALEYASNGIRVNNIGPGAINTTGNAERWADPKMKADVESMIPMGYIGEPEEIAAVAAWLASKEASYVTGITLFADGGMTLGPAFRPGRE

SEQ ID NO: 1379 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcacgcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgtggaacgtccactatgcctcgagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaactgaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgggccctgcgtttcgtccaggccgcgag

SEQ ID NO: 1380 - protein, 261 aa, Artificial Sequence
  Variant of Glucose Dehydrogenase from Bacillus subtilis
MYPDLKGKVVAITGAATGLGKAMAIRFGKEHAKVVINYYSNTQDPNAVKEEVIKAGGEAVVVQGDVTKEEDVKNIVQTAIKEFGTLDIMINNAGVENPVPSHELPLKDWDKVIATNLTGAFLGSREAIKYFVENDIKGNVINMSSVREVIPWPWNVHYASSKGGMKLMTKTLALEYASNGIRVNNIGPGAINTTGNAERWADPKLKADVESMIPMGYIGEPEEIAAVAAWLASKEASYVTGITLFADGGMTLGPAFRPGRE

SEQ ID NO: 1381 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcacgcaaaagtggttatcaactattatagtaatacgcaagatccgaacgctgtaaaagaagaggtcatcaagtggggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgaagaacgtccactatgcctcgagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaaactaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgggccctgcgtttgagccaggccgcgag

SEQ ID NO: 1382 - protein, 261 aa, Artificial Sequence
  Variant of Glucose Dehydrogenase from Bacillus subtilis
MYPDLKGKVVAITGAATGLGKAMAIRFGKEHAKVVINYYSNTQDPNAVKEEVIKWGGEAVVVQGDVTKEEDVKNIVQTAIKEFGTLDIMINNAGVENPVPSHELPLKDWDKVIATNLTGAFLGSREAIKYFVENDIKGNVINMSSVREVIPWPKNVHYASSKGGMKLMTKTLALEYASNGIRVNNIGPGAINTTGNAERWADPKTKADVESMIPMGYIGEPEEIAAVAAWLASKEASYVTGITLFADGGMTLGPAFEPGRE

SEQ ID NO: 1383 - DNA, 783 bp, Artificial Sequence
  Variant of Glucose Dehydrogenase from Bacillus subtilis
atgtatccggatttaaaaggaaaagtcgtcgctattacaggagctgctaccgggctcggaaaagcgatggccattcgcttcggcaaggagcaggcaaaagtggttatcaactattatagtaatacgcaagatccgaacgctgtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtgtcgaaaatcctgtgccatctcacgaactgccgctcaaggattgggataaagtcatcgcgacgaacttaacgggtgcctttttaggaagccgtgaagcgattaaatatttcgtagaaaacgatatcaagggaaatgtcattaacatgtccagtgtgcgtgaagtgattccttggccgttaaacgtccactatgccgcgagtaaaggcgggatgaagctgatgacaaaaacattagcgttggaatacgcgtcgaacggcattcgcgtcaataatattgggccaggtgcgatcaacacgacgggtaatgctgagcgctgggctgaccctaaacagaaagctgatgtagaaagcatgattccgatgggatatatcggcgaaccggaggagatcgccgcagtagcagcctggcttgcttcgaaggaagccagctacgtcacaggcatcacgttattcgcggacggcggtatgaccctgggccctgcgtttgagccaggccgcgag

SEQ ID NO: 1384 - protein, 261 aa, Artificial Sequence
  Variant of Glucose Dehydrogenase from Bacillus subtilis
MYPDLKGKVVAITGAATGLGKAMAIRFGKEQAKVVINYYSNTQDPNAVKEEVIKAGGEAVVVQGDVTKEEDVKNIVQTAIKEFGTLDIMINNAGVENPVPSHELPLKDWDKVIATNLTGAFLGSREAIKYFVENDIKGNVINMSSVREVIPWPLNVHYAASKGGMKLMTKTLALEYASNGIRVNNIGPGAINTTGNAERWADPKQKADVESMIPMGYIGEPEEIAAVAAWLASKEASYVTGITLFADGGMTLGPAFEPGRE

SEQ ID NO: 1385 - DNA, 783 bp, Artificial Sequence
  Variant of Glucose Dehydrogenase from Escherichia coli
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtcttgaaaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgcacgaagtgatttgttggccgttatttgtccactatgcggcaagtaaaggcgggatgaagctgatgacaaaaacattagcgttggaatacgcgccgaagggcattcgcgtcaataatattgggccaggtgcgatcaacacgacgatcaatgctgagaaatttgctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 1386 - protein, 261 aa, Artificial Sequence
  Variant of Glucose Dehydrogenase from Escherichia coli
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGLENPVPSHEMPLKDWDKVIGTNLTGAFLGSREAIKYFVENDIKGNVINMSSVHEVICWPLFVHYAASKGGMKLMTKTLALEYAPKGIRVNNIGPGAINTTINAEKFADPKQKADVESMIPMGYIGEPEEIAAVAAWLASKEASYVTGITLFADGGMTLYPSFQAGRG

SEQ ID NO: 1387 - DNA, 783 bp, Artificial Sequence
  Variant of Glucose Dehydrogenase from Escherichia coli
atgtatccggatttaaaaggaaaagtcgtcgctattacaggagctgcttcagggctcggaaaggcgatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtcttgaaaatcctgtgccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgcacgaagtgattccttggccgttatttgtccactatgcggcaagtaaaggcgggatgaagctgatgacaaaaacattagcgttggaatacgcgccgaagggcattcgcgtcaataatattgggccaggtgcgatcaacacgacgatcaatgctgagaaatttgctgaccctaaacagaaagctgatgtagaaagcatgaagccaatgggatatatcggcgaaccggaggagatcgccgcagtagcagcctggcttgcttcgaaggaagccagctacgtcacaggcatcacgttattcgcggacggcggtatgacactgtatccttcattccaggcaggccgcggt

SEQ ID NO: 1388 - protein, 261 aa, Artificial Sequence
  Variant of Glucose Dehydrogenase from Escherichia coli
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGLENPVPSHEMPLKDWDKVIGTNLTGAFLGSREAIKYFVENDIKGNVINMSSVHEVIPWPLFVHYAASKGGMKLMTKTLALEYAPKGIRVNNIGPGAINTTINAEKFADPKQKADVESMKPMGYIGEPEEIAAVAAWLASKEASYVTGITLFADGGMTLYPSFQAGRG

What is claimed is:

1. An engineered glucose dehydrogenase polypeptide comprising a polypeptide sequence having at least 90%, 91%, 92%, 93%, 94%, 95%, 96%, 97%, 98%, or 99% sequence identity to SEQ ID NO:4, wherein said engineered glucose dehydrogenase polypeptide comprises a substitution at amino acid position 147 in said polypeptide sequence selected from the group consisting of H147A/S/I/T/Q/R, wherein the amino acid positions of said polypeptide sequence are numbered with reference to SEQ ID NO:4, and wherein said engineered glucose dehydrogenase polypeptide exhibits improved production of compound (1) compared to the engineered glucose dehydrogenase polypeptide of SEQ ID NO:4.

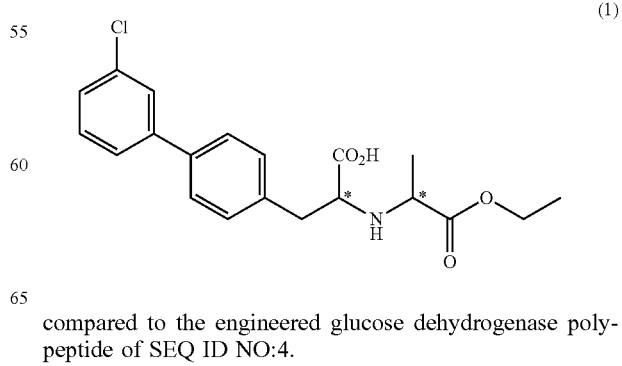

(1)

2. The engineered glucose dehydrogenase polypeptide of claim 1, wherein said polypeptide sequence has at least 90%, 91%, 92%, 93%, 94%, 95%, 96%, 97%, 98%, 99% sequence identity to SEQ ID NO:4, wherein said engineered glucose dehydrogenase polypeptide further comprises at least one substitution or substitution set in said polypeptide sequence at one or more amino acid positions selected from 96, 96/118,155, 155/253, 195, 200, and 256, and wherein the amino acid positions of said polypeptide sequence are numbered with reference to SEQ ID NO: 4.

3. The engineered glucose dehydrogenase polypeptide of claim 1, wherein said polypeptide sequence has at least 90%, 91%, 92%, 93%, 94%, 95%, 96%, 97%, 98%, 99% sequence identity to SEQ ID NO:14, wherein said engineered glucose dehydrogenase polypeptide comprises at least one substitution or substitution set in said polypeptide sequence at one or more amino acid positions selected from 17, 95/96, 95/96/118, 95/96/118/156/200/253, 95/96/147, 95/96/147/200, 95/96/147/200/253, 95/96/155/156, 95/96/155/195/200, 95/96/159/195/253, 95/155/156, 95/155/159/200, 95/155/200, 96, 96/147/195/200/253, 96/155, 96/155/159, 96/155/159/195, 96/155/159/200, 96/156/159/195, 96/156/159/195/200, 96/195,147/155, 147/155/156, 147/155/156/200, 147/155/159, 147/195/200/253, 155, 155/156, 155/156/195/200/253, 155/159/200, and 253, and wherein the amino acid positions of said polypeptide sequence are numbered with reference to SEQ ID NO: 14.

4. The engineered glucose dehydrogenase polypeptide of claim 1, wherein said polypeptide sequence has at least 90%, 91%, 92%, 93%, 94%, 95%, 96%, 97%, 98%, 99% sequence identity to SEQ ID NO:34, wherein said engineered glucose dehydrogenase polypeptide comprises at least one substitution or substitution set in said polypeptide sequence at one or more amino acid positions selected from 17, 17/21, 17/21/42, 17/21/42/155/260, 17/21/49, 17/21/49/51, 17/21/49/51/96, 17/21/49/51/260, 17/21/49/96/155/260, 17/21/49/260, 17/21/51/96, 17/21/51/195, 17/21/96, 17/21/96/155, 17/21/96/195/260, 17/21/96/253, 17/21/147/155/253, 17/21/155/253, 17/21/195, 17/21/253, 17/42, 17/42/49/195/260, 17/42/96, 17/44, 17/44/47/51/96, 17/44/47/51/96/114/147/195/199/253, 17/44/47/51/96/114/147/199, 17/44/47/51/96/114/195/199, 17/44/47/51/96/147/253, 17/44/47/51/178/195, 17/44/47/195/199, 17/44/51/114/195/253, 17/46/47/51/96/147, 17/46/47/51/96/195/253, 17/46/47/51/155, 17/46/47/51/155/195/199, 17/46/47/96/195, 17/46/47/178, 17/46/96/253, 17/47, 17/47/51, 17/47/51/96/114/147/195, 17/47/51/96/114/155/178/253, 17/47/51/96/195, 17/47/51/96/195/199, 17/47/96/114/155/253, 17/47/96/147/155/195/199, 17/47/96/147/195/199/253, 17/47/96/155, 17/47/96/195/199, 17/47/114, 17/47/114/155/195/199/253, 17/47/147/195/199/253, 17/49, 17/49/51, 17/49/51/96/195/253, 17/49/51/155/253, 17/49/51/155/253/260, 17/49/51/155/260, 17/49/51/253, 17/49/96, 17/49/96/155/253, 17/49/96/195, 17/49/260, 17/51, 17/51/96/114, 17/51/96/155/178, 17/51/96/155/195/199/253, 17/51/96/155/199, 17/51/96/155/253, 17/51/96/178/195/199, 17/51/96/195, 17/51/96/260, 17/51/114, 17/51/114/253, 17/51/147, 17/51/155/195, 17/51/178/195/253, 17/51/253, 17/96, 17/96/114/147/155, 17/96/114/147/155/178/195/199, 17/96/147, 17/96/147/155, 17/96/155/178, 17/96/155/178/253, 17/96/155/195, 17/96/155/195/199, 17/96/178, 17/96/178/195, 17/96/195, 17/96/195/199, 17/96/195/199/253, 17/96/253, 17/114, 17/114/253, 17/147/155/253, 17/147/178,17/147/199, 17/155, 17/155/178, 17/155/178/195, 17/155/195, 17/155/195/253, 17/155/199, 17/155/253, 17/178, 17/178/195/253, 17/195, 17/195/199, 17/195/199/253, 17/195/253, 17/199, 17/253, 17/260, 21/49/51, 21/49/96/195, 21/49/96/253, 21/49/195, 21/51/96/155, 21/96, 21/96/195, 21/96/253, 44/46/47/51/114/178/253, 44/46/47/51/155/178/253, 44/46/47/96/155/195, 44/46/51/96/147/178/195/199, 44/46/51/96/155/195/199/253, 44/46/51/96/195, 44/46/51/147/155/178/195/253, 44/47/51/96/114, 44/47/51/96/177/178/199/253, 44/47/51/114/178/253, 44/47/96/114, 44/47/96/195/253, 44/47/147/155, 44/47/147/155/199, 44/96/155/178, 46/47/51/96/114/178, 46/47/51/114/147/195/199, 46/47/51/155/195/199, 46/47/96/114/195/199, 46/47/96/155/178/195/253, 46/47/155/195/199, 46/114/147/155/178/195/199, 46/114/195/199/253, 47/51/96, 47/51/96/114, 47/51/96/147/155/195/199, 47/51/96/147/195/199, 47/51/96/178/195/199/253, 47/51/96/195, 47/51/96/195/199/253, 47/51/114/253, 47/51/155/178/195, 47/51/155/195/253, 47/96/114, 47/96/114/253, 47/96/155/178/195, 47/96/155/195, 47/96/155/195/199, 47/96/178/195/253, 47/96/178/253, 47/96/195/199/253, 47/96/195/253, 47/114, 47/114/155/195/199, 47/114/178, 47/147/195, 47/155/253, 47/178/195, 47/178/195/199, 47/195/199, 49/51/96, 49/96, 49/96/253, 51/96, 51/96/114/155/195/199/253, 51/96/155/178, 51/96/155/178/195/253, 51/96/155/195, 51/96/155/195/253, 51/96/195/253, 51/96/199, 51/96/253, 51/114/155/195/199, 51/114/195/199, 51/147/253, 51/155/195/199, 51/195, 51/253, 96, 96/114/147/155/195/199, 96/114/155/178/195/199/253, 96/114/155/195/253, 96/114/199, 96/147, 96/147/155/178/195/253, 96/147/178/195/199, 96/147/195, 96/147/195/199, 96/147/253, 96/155/178/199, 96/155/195, 96/155/199, 96/155/253, 96/178/195, 96/178/195/199, 96/195, 96/195/199, 96/195/253, 96/199, 96/199/253, 96/253,114, 114/147/155/253, 114/178/195/199/253, 114/195, 114/195/199/253, 132, 147/155, 149, 154, 155/178, 155/178/195/199, 155/195, 155/195/199, 155/195/199/253, 155/195/253, 155/253, 157, 167, 170, 178, 178/195, 178/199, 195, 196, 198, 214, 218, 251, 252, 256, 257, 259, and 260, and wherein the amino acid positions of said polypeptide sequence are numbered with reference to SEQ ID NO: 34.

5. The engineered glucose dehydrogenase polypeptide of claim 1, wherein said polypeptide sequence has at least 90%, 91%, 92%, 93%, 94%, 95%, 96%, 97%, 98%, 99% sequence identity to SEQ ID NO: 112, wherein said engineered glucose dehydrogenase polypeptide comprises at least one substitution or substitution set in said polypeptide sequence at one or more amino acid positions selected from 21/42/96/178/195/253, 21/42/96/195, 21/96, 21/96/147/195, 21/96/149, 21/96/155/195/253, 21/96/167, 21/96/167/195, 21/96/178, 21/96/179/195/251/253, 21/96/195, 21/147/149, 21/147/253, 21/149/178/195, 21/155/178/253/256, 21/178/195/256, 42/96/149/253/256, 94, 96, 96/114/155/198/218/253/256/257, 96/114/155/252/253/257, 96/114/155/253, 96/114/196/214/253/256, 96/114/214/253/256, 96/147, 96/147/149, 96/147/149/155, 96/147/167/195, 96/149/155/167/178/253, 96/149/155/195,96/149/178/179/251/256, 96/149/178/253, 96/149/198/252/253/257, 96/155, 96/155/167, 96/155/167/178, 96/155/195, 96/155/196/218/253/256/257, 96/155/196/252/253, 96/155/198, 96/155/252/253, 96/167, 96/178, 96/178/179/195, 96/195, 96/196, 96/196/198, 96/196/201/256, 96/251/253/256, 96/253/257, 96/256/257, 98, 103, 114/253/256/257, 147/149, 149/167, 149/195, 149/218, 149/253, 149/257, 155/167, 155/178/195, 155/178/195/251/253, 155/195/251/253/256, 155/195/253/256, 155/196/198/253, 167, 167/195, 167/195/251/253, 196, 196/253/256/257, 198/253/256, 198/256, 205, 214/253/256, 251, and 257, and wherein the amino acid positions of said polypeptide sequence are numbered with reference to SEQ ID NO: 112.

6. The engineered glucose dehydrogenase polypeptide of claim 1, wherein said polypeptide sequence has at least 90%, 91%, 92%, 93%, 94%, 95%, 96%, 97%, 98%, 99% sequence identity to SEQ ID NO: 736, wherein said engineered glucose dehydrogenase polypeptide comprises at least one substitution or substitution set in said polypeptide sequence at one or more amino acid positions selected from 21/47/ 96/114/155/251, 21/47/149/257, 21/47/155/178/257, 21/47/ 178, 21/47/178/251/256/257, 21/96/114/155/178, 21/114/ 155/251/257, 21/114/178/179, 21/155/178/209/256, 25/155, 25/178/256, 42/47/155/178, 47/114/149/178/251, 47/114/ 178/257, 47/149, 47/178, 47/178/179/251/257, 47/178/251/ 257, 96/114/155/198, 96/114/155/253/257, 96/253,114/149/ 155/251/256, 114/149/178/256/257, 114/155/195/198/256, 114/209/256/257, 149, 149/256/257, 155, 155/178/179, 155/ 178/198/252/253, 155/195/198, 155/195/198/253/256/257, 155/256/257, 178/253, 178/256, 179/256/257, 251, and 253, and wherein the amino acid positions of said polypeptide sequence are numbered with reference to SEQ ID NO: 736.

7. The engineered glucose dehydrogenase polypeptide of claim 1, wherein said polypeptide sequence has at least 90%, 91%, 92%, 93%, 94%, 95%, 96%, 97%, 98%, 99% sequence identity to SEQ ID NO: 908, wherein said engineered glucose dehydrogenase polypeptide comprises at least one substitution or substitution set in said polypeptide sequence at one or more amino acid positions selected from 21/42/ 149, 21/42/149/214/253, 21/42/179/214/244/253, 21/42/ 253/260/261, 21/149, 21/149/179, 21/149/179/253, 21/149/ 179/253/260, 21/149/179/253/260/261, 21/149/179/261, 21/149/260/261, 21/149/261, 21/179/214/253, 21/179/253, 21/179/261, 21/214/253, 21/253, 40, 42/149/179/253/260, 42/149/179/260/261, 42/149/214/253, 42/179/253/261, 42/253,104, 111, 149, 149/179, 149/179/253, 149/179/253/ 260/261, 149/179/260, 149/179/260/261, 149/179/261, 149/ 253, 149/261, 160, 178, 179/214/253, 179/253, 179/253/ 260, 179/253/260/261, 179/253/261, 179/260/261, 179/261, 253,253/260/261, 253/261, and 255, and wherein the amino acid positions of said polypeptide sequence are numbered with reference to SEQ ID NO: 908.

8. The engineered glucose dehydrogenase polypeptide of claim 1, wherein said polypeptide sequence has at least 90%, 91%, 92%, 93%, 94%, 95%, 96%, 97%, 98%, 99% sequence identity to SEQ ID NO: 956 wherein said engineered glucose dehydrogenase polypeptide comprises at least one substitution or substitution set in said polypeptide sequence at one or more amino acid positions selected from 3, 21/104/160/178/179, 21/104/160/255/258, 21/104/178/179/ 255, 21/104/178/255/258, 21/104/255, 21/104/255/258, 21/178/179/255/260, 21/255/260, 31, 32, 40, 40/104/178/ 179, 40/160/178, 46/82/259, 103, 104/149/255/258/260, 104/149/258, 104/160, 104/160/178,104/160/178/179/255, 104/160/178/179/260, 104/160/178/255/260, 104/160/179, 104/178/179/255/258, 104/178/255/258/260, 104/178/255/ 260,104/179,104/255/260,104/258/260, 111/149/255/258, 111/149/255/260,111/160/178/179/255/258/260, 111/160/ 255/260,154,156,160, 160/178/179, 174, 194, 197, 205, 205/229, 222, 253, 257, 258/260, and 260, and wherein the amino acid positions of said polypeptide sequence are numbered with reference to SEQ ID NO: 956.

9. The engineered glucose dehydrogenase polypeptide of claim 1, wherein said polypeptide sequence has at least 90%, 91%, 92%, 93%, 94%, 95%, 96%, 97%, 98%, 99% sequence identity to SEQ ID NO: 1062, wherein said engineered glucose dehydrogenase polypeptide comprises at least one substitution or substitution set in said polypeptide sequence at one or more amino acid positions selected from 3/31/154/ 205/257, 3/31/205, 3/154/205, 31/55/154/205, 31/55/205, 31/154/205, 31/154/205/257, 31/205, 31/205/222,40/55/ 205,40/154/205, 40/154/205/257, 40/174/205/229, 40/205/ 229, 54/205/253, 63, 63/149/154/174/178/253, 63/149/154/ 174/205/253, 63/149/156/178/205/253, 63/149/205,63/149/ 205/229/253, 63/149/205/253,63/154, 63/154/178/205/253, 63/154/205,63/154/205/229,63/154/205/229/253, 63/154/ 205/253,63/156, 63/156/205, 63/205, 63/205/253, 63/253, 67, 98,149/154, 149/154/205, 149/156/253, 149/205, 149/ 205/253, 154, 154/160, 154/160/205, 154/160/205/222/257, 154/160/253, 154/174, 154/174/178/205, 154/174/205/229, 154/205, 154/205/222, 154/205/222/257, 154/205/229, 154/ 205/253, 154/205/257, 154/229,154/253, 156/205, 156/205/ 253, 156/229/253, 160,160/205, 160/205/229, 194, 205, 205/222, 205/229, 205/229/253, 205/253, 208, 226, and 253, and wherein the amino acid positions of said polypeptide sequence are numbered with reference to SEQ ID NO: 1062.

10. The engineered glucose dehydrogenase polypeptide of claim 1, wherein said engineered glucose dehydrogenase polypeptide comprises a polypeptide sequence that is at least 92%, 93%, 94%, 95%, 96%, 97%, 98%, or 99% identical to SEQ ID NO:4.

11. The engineered glucose dehydrogenase polypeptide of claim 1, wherein said engineered glucose dehydrogenase polypeptide comprises SEQ ID NO: 14.

12. The engineered glucose dehydrogenase polypeptide of claim 1, wherein said engineered glucose dehydrogenase polypeptide comprises an amino acid sequence with at least 92% sequence identity to any even-numbered sequence set forth in SEQ ID NO:6, 8, 14, and 32-1384.

13. The engineered glucose dehydrogenase polypeptide of claim 1, wherein said engineered glucose dehydrogenase polypeptide comprises a polypeptide sequence set forth in the even numbered sequences of SEQ ID NOs: 6-1384.

14. The engineered glucose dehydrogenase polypeptide of claim 1, wherein said engineered glucose dehydrogenase polypeptide further exhibits improved production of a compound of structural Formula (IV)

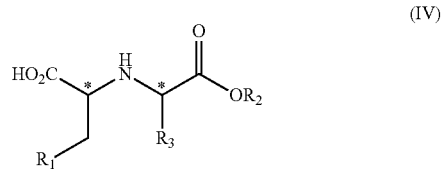

(IV)

wherein $R_1$ is selected from a hydrogen atom, or optionally substituted alkyl, alkenyl, alkynyl, alkoxy, arylalkoxy, hydroxyalkyl, heteroalkyl, heteroalkenyl, heteroalkynyl, haloalkyl, alkylthioalkyl, cycloalkyl, aryl, arylalkyl, heterocycloalkyl, heteroaryl, and heteroarylalkyl; and wherein R2 is independently selected from alkyl, alkenyl, alkynyl, hydroxyalkyl, carboxy, aminocarbonyl, heteroalkyl, heteroalkenyl, heteroalkynyl, carboxyalkyl, alkylamino, haloalkyl, alkylthioalkyl, cycloalkyl, aryl, arylalkyl, heterocycloalkyl, heteroaryl, and heteroarylalkyl; and wherein R3 is independently selected from methyl, $D_3$-methyl and ethyl.

15. The engineered glucose dehydrogenase polypeptide of claim 1, wherein said engineered glucose dehydrogenase polypeptide further exhibits improved utilization of compound (2)

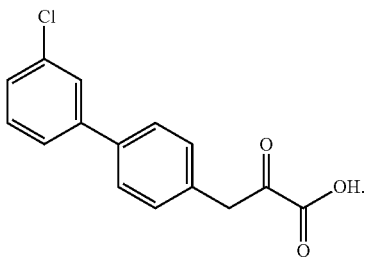
(2)

16. The engineered glucose dehydrogenase polypeptide of claim 1, wherein said engineered glucose dehydrogenase polypeptide further exhibits improved utilization of compound (3)

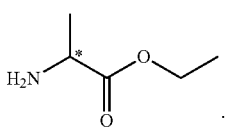
(3)

17. The engineered glucose dehydrogenase polypeptide of claim 1, wherein said engineered glucose dehydrogenase polypeptide exhibits improved production of compound (1)

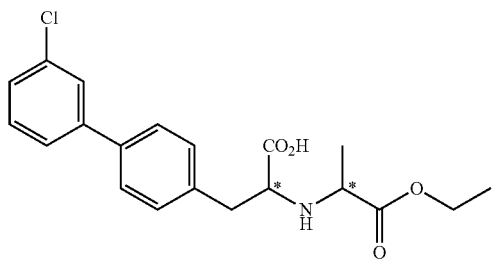
(1)

from compound (2)

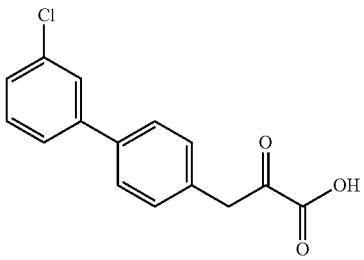
(2)

and compound (3)

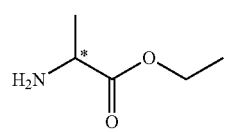
(3)

18. The engineered glucose dehydrogenase polypeptide of claim 1, wherein said engineered glucose dehydrogenase polypeptide further exhibits improved enantioselectivity.

19. The engineered glucose dehydrogenase polypeptide of claim 1, wherein said engineered glucose dehydrogenase polypeptide further exhibits improved stability.

20. The engineered glucose dehydrogenase polypeptide of claim 1, wherein said engineered glucose dehydrogenase polypeptide is purified.

21. A composition comprising at least one glucose dehydrogenase polypeptide provided in claim 1.

\* \* \* \* \*